US012297439B2

(12) United States Patent
Kelliher et al.

(10) Patent No.: US 12,297,439 B2
(45) Date of Patent: May 13, 2025

(54) COMPOSITIONS AND METHODS FOR DRIVING T1 EVENT DIVERSITY

(71) Applicant: Syngenta Crop Protection AG, Basel (CH)

(72) Inventors: Timothy Kelliher, Research Triangle Park, NC (US); Jiang Li, Beijing (CN); Julie Leonard Green, Woodland, CA (US); Zhongying Chen, Research Triangle Park, NC (US); Wan Shi, Beijing (CN); Guozhu Tang, Research Triangle Park, NC (US)

(73) Assignee: Syngenta Crop Protection AG, Basel (CH)

( * ) Notice: Subject to any disclaimer, the term of this patent is extended or adjusted under 35 U.S.C. 154(b) by 225 days.

(21) Appl. No.: 17/429,125

(22) PCT Filed: Feb. 24, 2020

(86) PCT No.: PCT/US2020/019499
§ 371 (c)(1),
(2) Date: Aug. 6, 2021

(87) PCT Pub. No.: WO2020/176412
PCT Pub. Date: Sep. 3, 2020

(65) Prior Publication Data
US 2022/0145312 A1    May 12, 2022

(30) Foreign Application Priority Data
Feb. 25, 2019   (WO) ................ PCT/CN2019/076062

(51) Int. Cl.
*C12N 15/82*          (2006.01)
(52) U.S. Cl.
CPC ..... *C12N 15/8213* (2013.01); *C12N 15/8231* (2013.01); *C12N 15/8233* (2013.01)
(58) Field of Classification Search
None
See application file for complete search history.

(56) References Cited

U.S. PATENT DOCUMENTS

| 2018/0092316 A1 | 4/2018 | Chintamanani et al. |
| 2018/0223295 A1 | 8/2018 | Harling et al. |
| 2018/0273963 A1 | 9/2018 | Kelliher et al. |
| 2020/0299717 A1* | 9/2020 | Pennell ............. C12N 15/8286 |

FOREIGN PATENT DOCUMENTS

| CN | 108486145 A | * | 9/2018 | ......... C12N 15/8213 |
| WO | 2017/087682 A1 | | 5/2017 | |
| WO | 2017/096237 | | 6/2017 | |
| WO | WO-2017096237 A1 | * | 6/2017 | ............... A01H 1/02 |

OTHER PUBLICATIONS

Bilas, Róża, et al. "Cis-regulatory elements used to control gene expression in plants." Plant Cell, Tissue and Organ Culture (PCTOC) 127 (2016): 269-287. (Year: 2016).*
Hyun, Youbong, et al. "Site-directed mutagenesis in *Arabidopsis thaliana* using dividing tissue-targeted RGEN of the CRISPR/Cas system to generate heritable null alleles." Planta 241 (2015): 271-284. (Year: 2015).*
Hyun, Youbong, et al. "The catalytic subunit of *Arabidopsis* DNA polymerase α ensures stable maintenance of histone modification." Development 140.1 (2013): 156-166. (Year: 2013).*
Laxa, Miriam. "Intron-mediated enhancement: a tool for heterologous gene expression in plants?." Frontiers in Plant Science 7 (2017): 227098 (Year: 2017).*
Gao, Yangbin, et al. "Auxin binding protein 1 (ABP1) is not required for either auxin signaling or *Arabidopsis* development." Proceedings of the National Academy of Sciences 112.7 (2015): 2275-2280. (Year: 2015).*
International Search Report for International Application No. PCT/US2020/019499 mailed Aug. 14, 2020.
Tang et al., "Development and Validation of an Effective CRISPR/Cas9 Vector for Efficiently Isolating Positive Transformants and Transgene-Free Mutants in a Wide Range of Plant Species," Frontiers in Plant Science, Oct. 2018, vol. 9, Article 1533, pp. 1-14.
Mao et al. "Development of germ-line-specific CRISPR-Cas9 systems to improve the production of heritable gene modifications in *Arabidopsis*", Plant Biotechnology Journal (2016) 14, pp. 519-532.
Wang Z. et al., "Egg cell-specific promoter-controlled CRISP/Cas9 efficiently homozygous mutants for multiple target genes in *Arabidopsis* in a single generation", Genome Biology Central LTD., vol. 16, N°1: 144, Jul. 21, 2015.
Singha Dhanawantari et al: "Harnessing tissue-specific genome editing in plants through CRISPR/Cas9 system: current state & future prospects", Planta, Springer Berlin Heidelberg, Berlin/Heidelberg, vol. 255(1), Dec. 28, 2021.

(Continued)

*Primary Examiner* — Weihua Fan
(74) *Attorney, Agent, or Firm* — Syngenta Crop Protection AG

(57) ABSTRACT

Systems and methods for producing a plurality of unique edits in a plant's T1 seed. In one example, a method comprises transforming at least one expression cassette into a plant cell or a plant tissue. The at least one expression cassette may comprise a nucleic acid that encodes a DNA modification enzyme; optionally, a nucleic acid that encodes at least one guide RNA (gRNA); and a floral mosaic (FMOS) regulatory sequence, wherein the FMOS regulatory sequence (i) mediates expression of the DNA modification enzyme in at least one of a floral primordia cell and a floral reproductive organ, and (ii) mediates a plurality of edits in the at least one of the floral primordia and the floral reproductive organ. The method may also include regenerating the plant cell or plant tissue into a T0 plant having a plurality of T1 seed, wherein the T1 seed contain a plurality of unique edits.

20 Claims, 47 Drawing Sheets

Specification includes a Sequence Listing.

(56) References Cited

OTHER PUBLICATIONS

Deepa Jaganathan et al: "CRISPR for Crop Improvement: An Update Review", Frontiers in Plant Science, vol. 9, Jul. 17, 2018.
Eid Ayman et al: "High efficiency of targeted mutagenesis in *Arabidopsis* via meiotic promoter-driven expression of Cas9 endonuclease", Plant Cell Reports, Springer Berlin Heidelberg, Berlin/Heidelberg, vol. 35(7), May 28, 2016, pp. 1555-1558.
Yan Liuhua: "High-Efficiency Genome Editing in *Arabidopsis* Using YAO Promoter-Driven CRISPR/Cas9 System", Molecular Plant, Dec. 31, 2015, pp. 1820-1823.
Extended European Search Report mailed Oct. 28, 2022 cited in EP Application No. 20763715.8 filed Sep. 23, 2021.

* cited by examiner

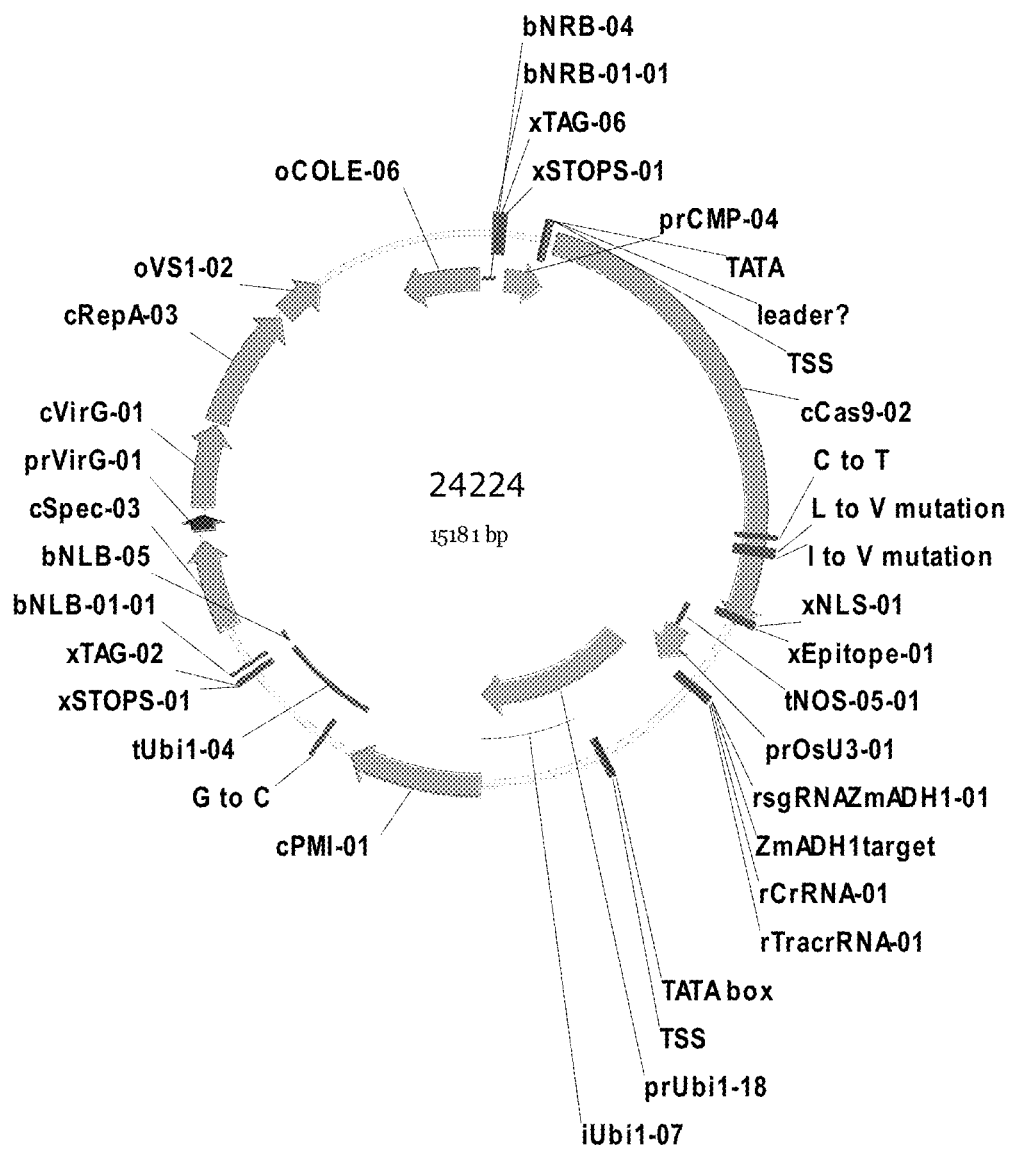
Figure 3 (Vector 24224 Control)

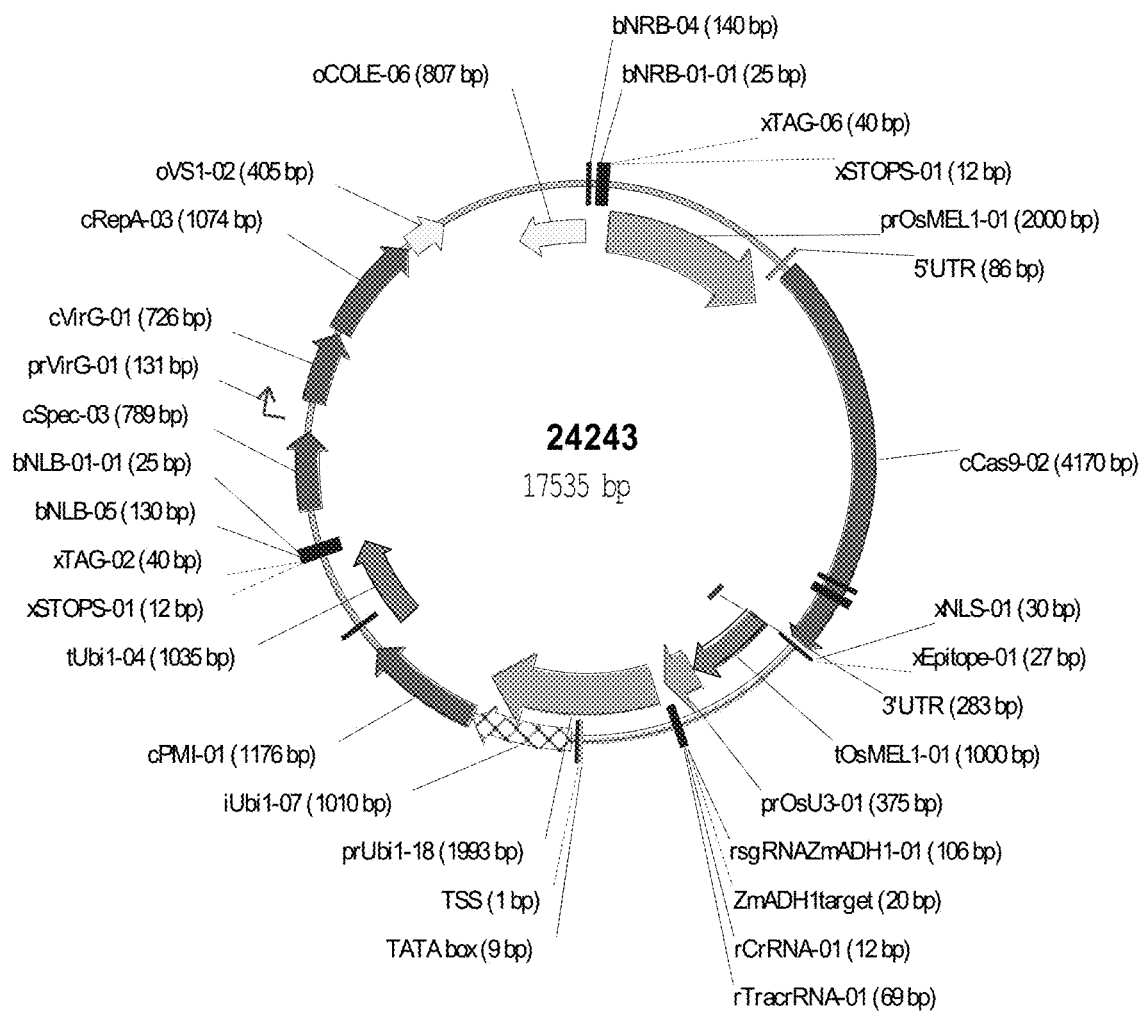
Figure 4 (Vector 24243)

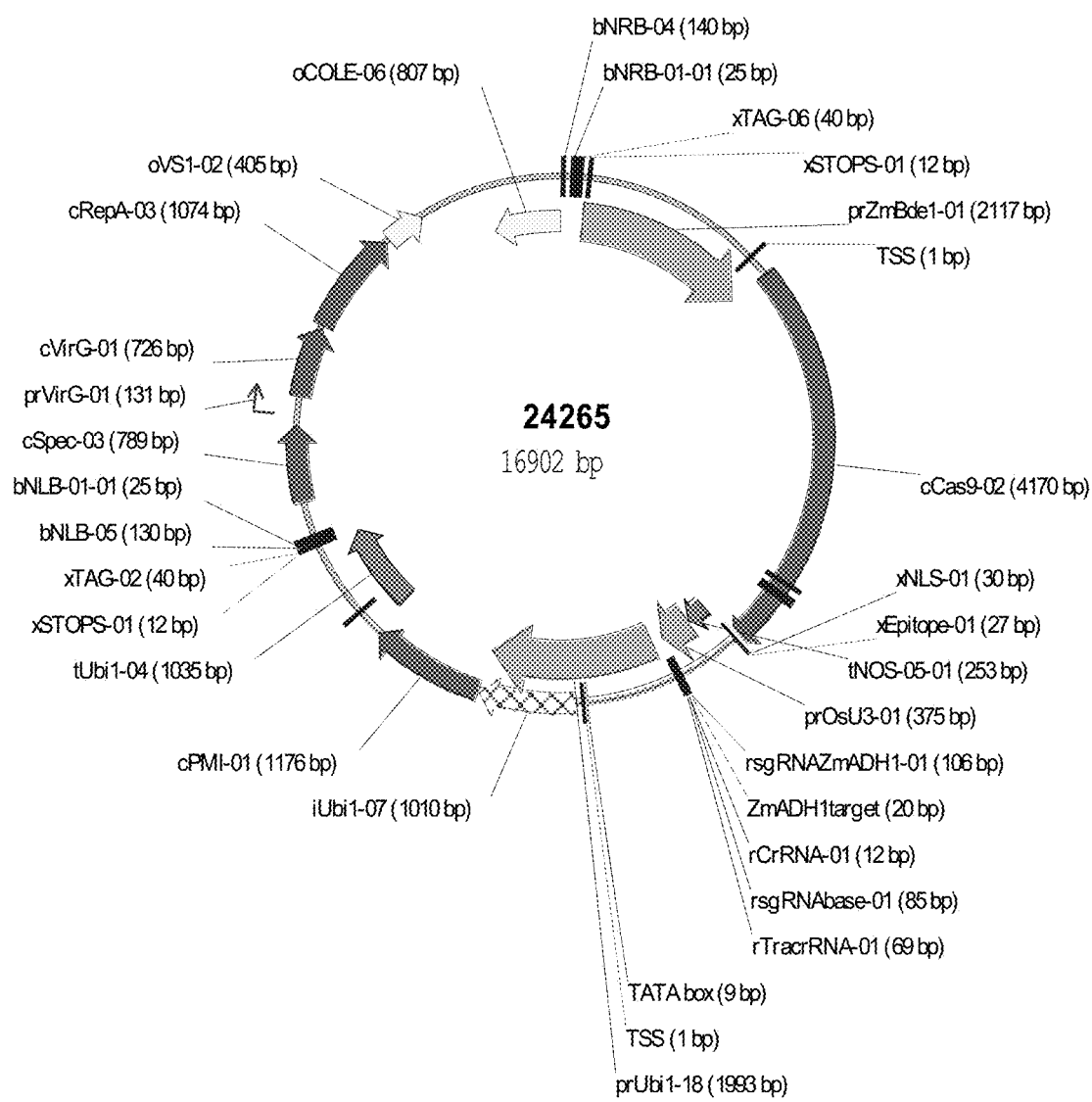
Figure 5 (Vector 24265)

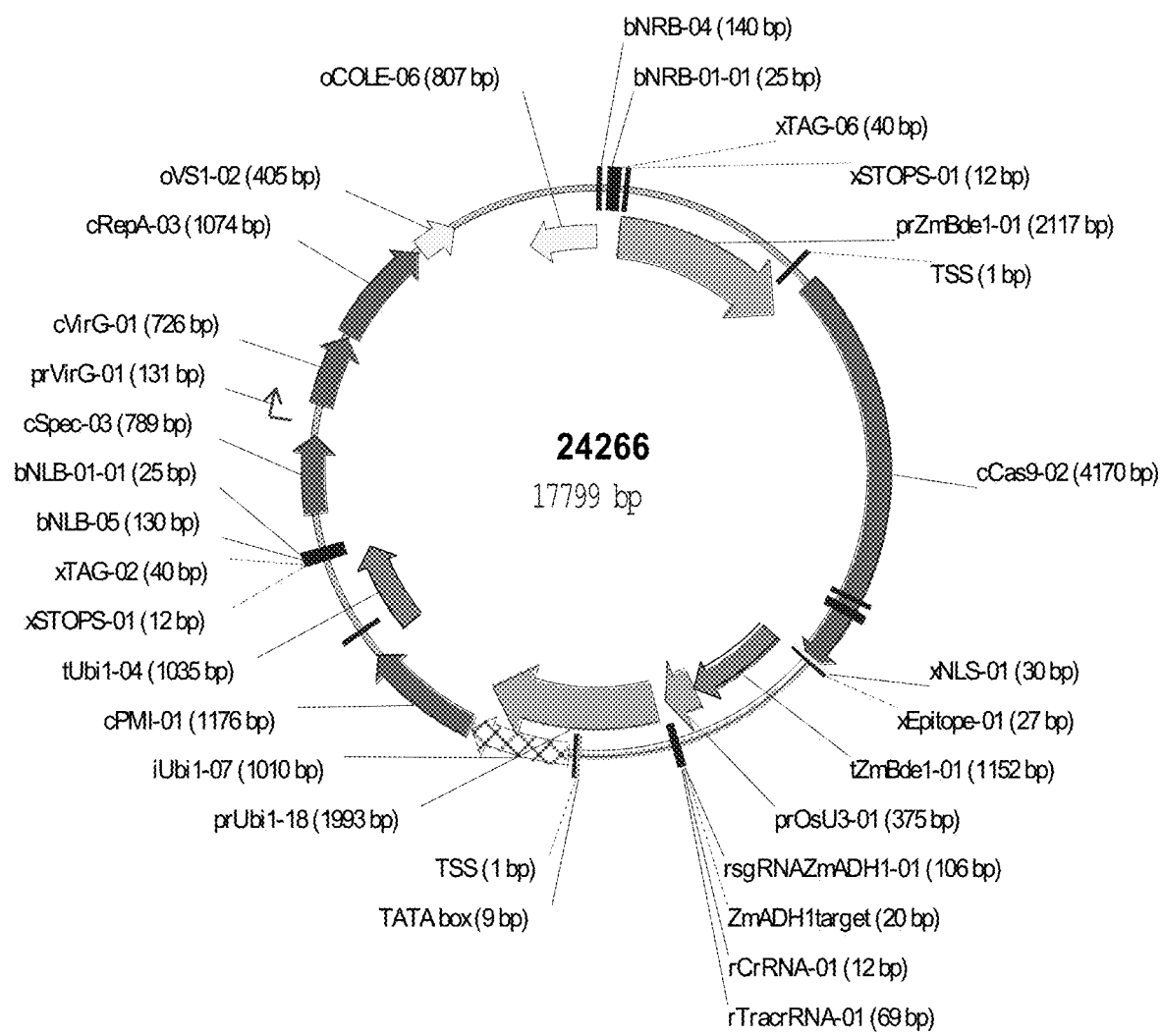
Figure 6 (Vector 24266)

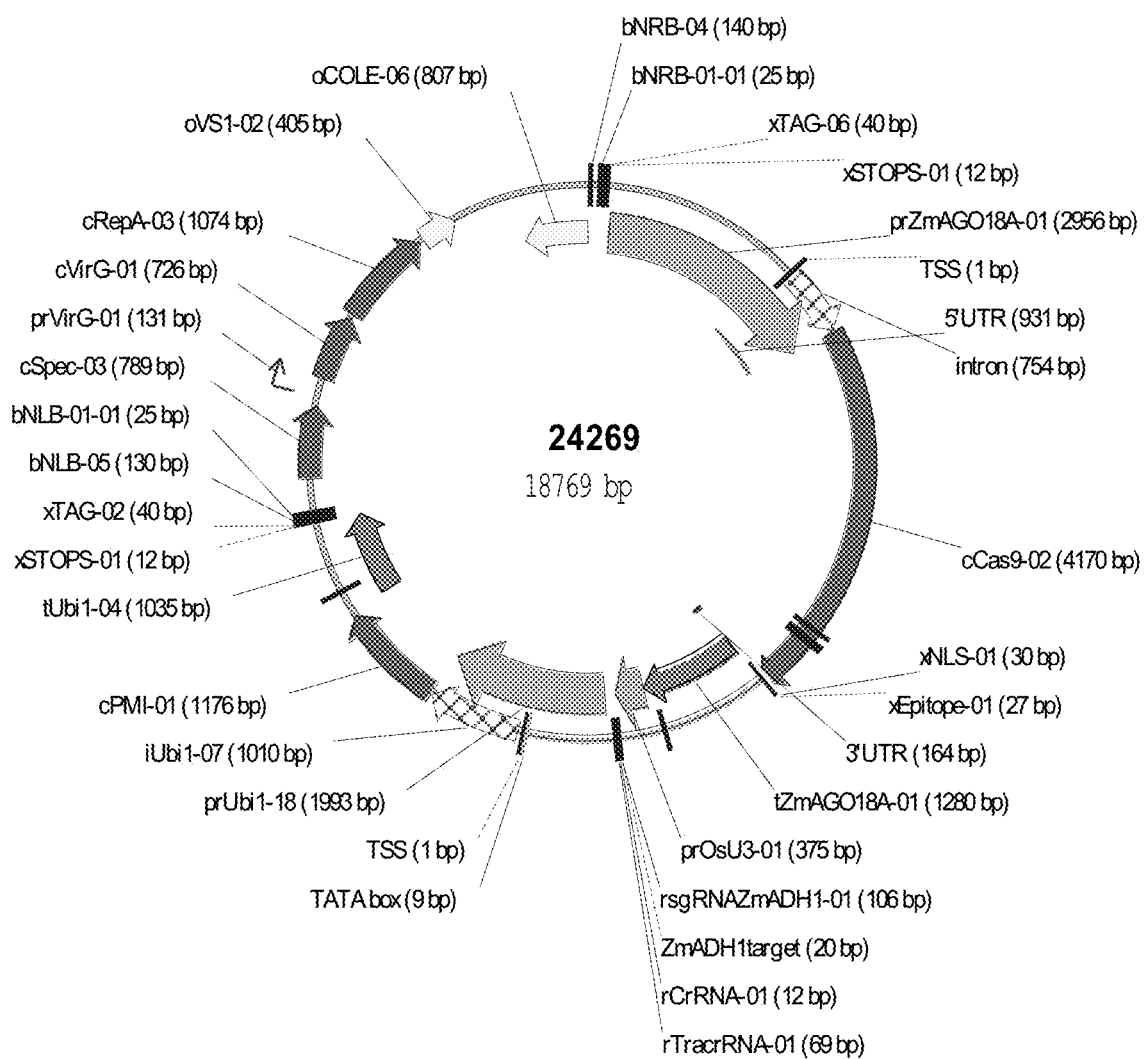
Figure 7 (Vector 24269)

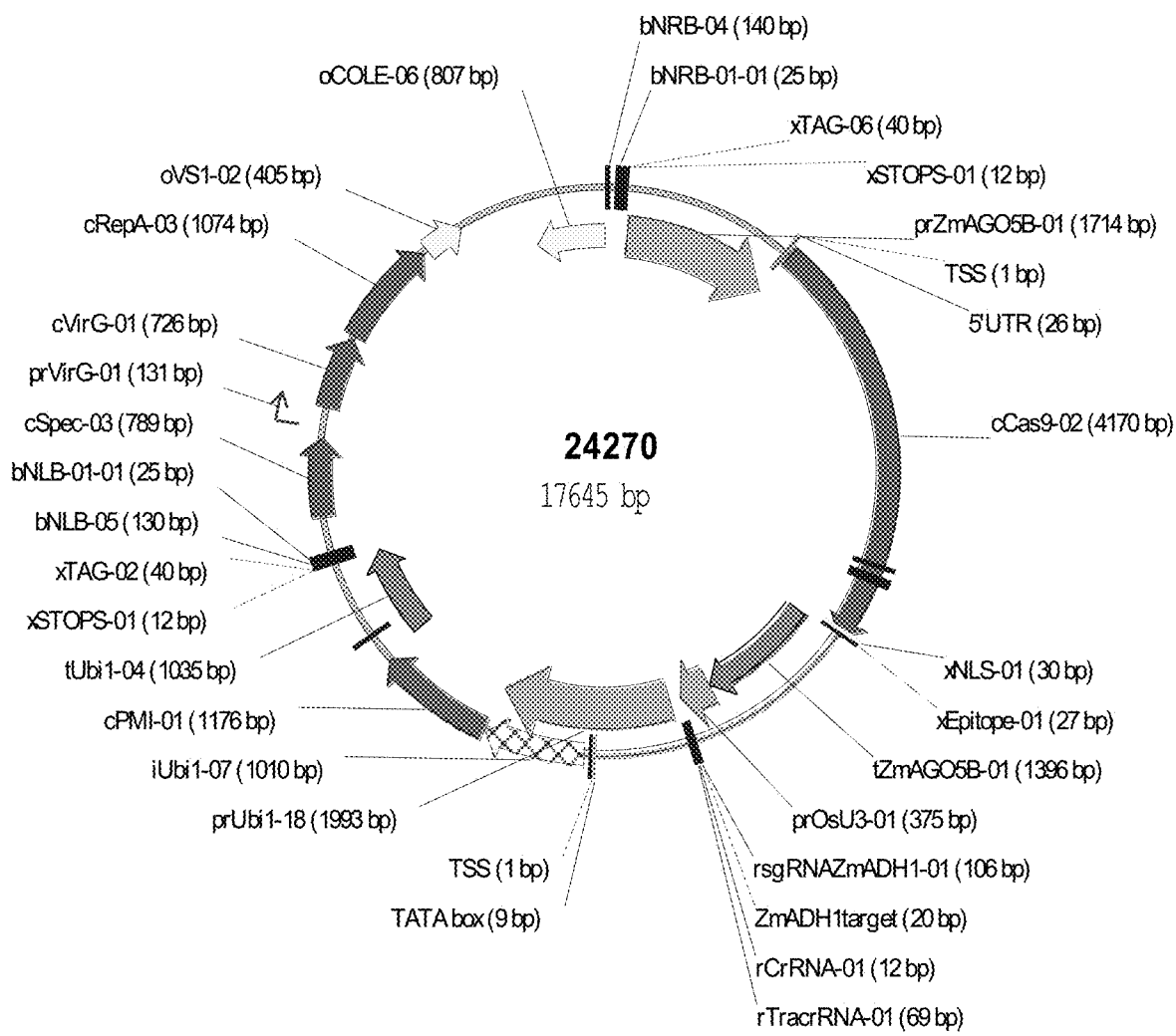
Figure 8 (Vector 24270)

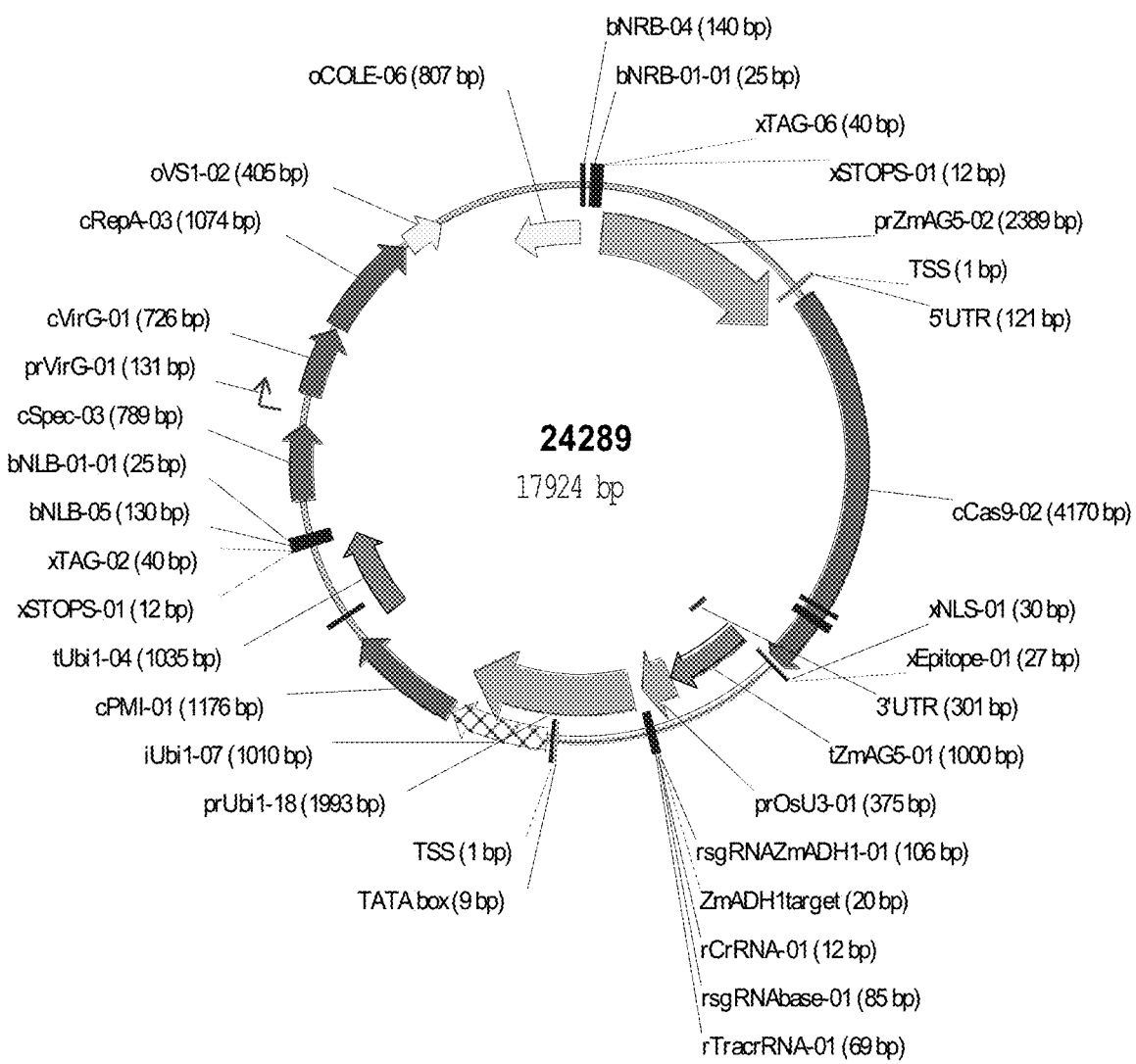
Figure 9 (Vector 24289)

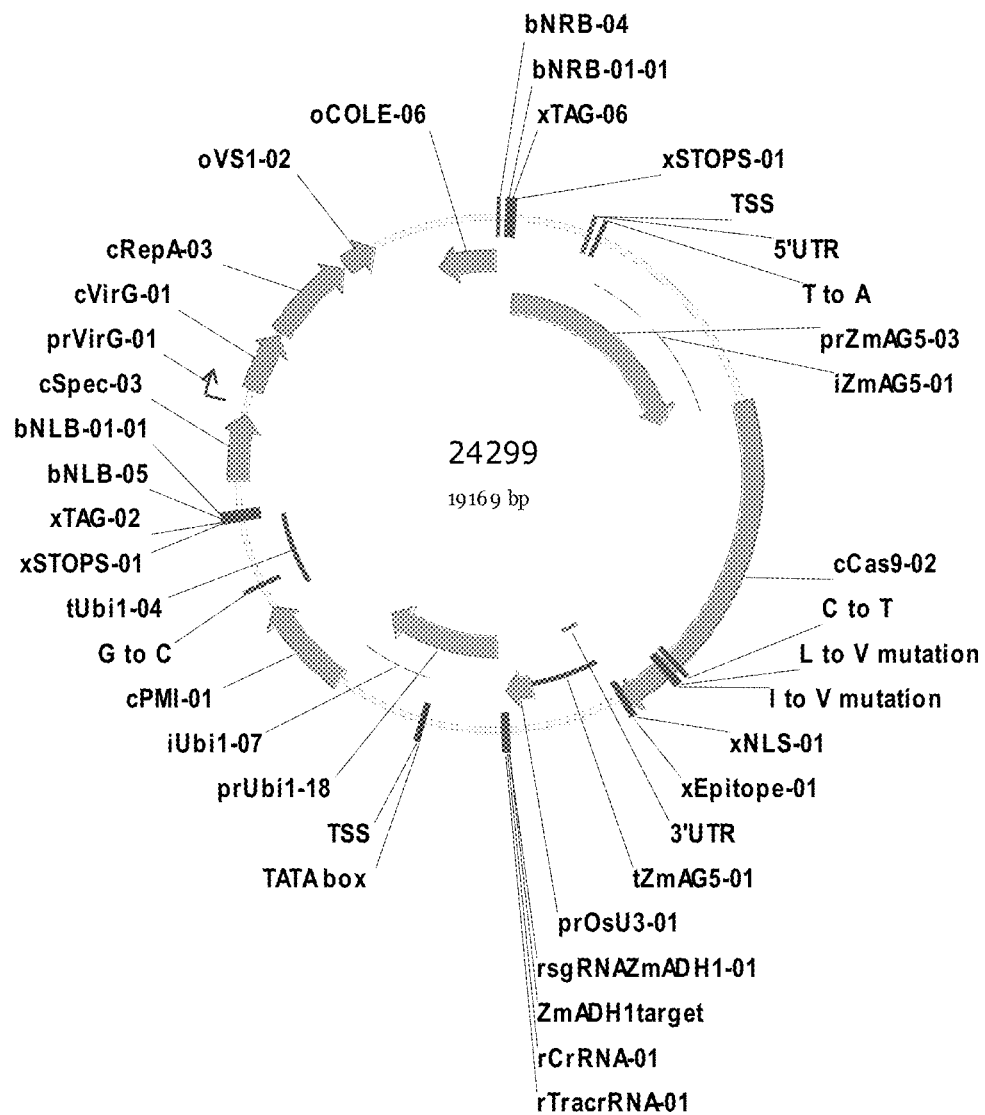
Figure 10 (Vector 24299)

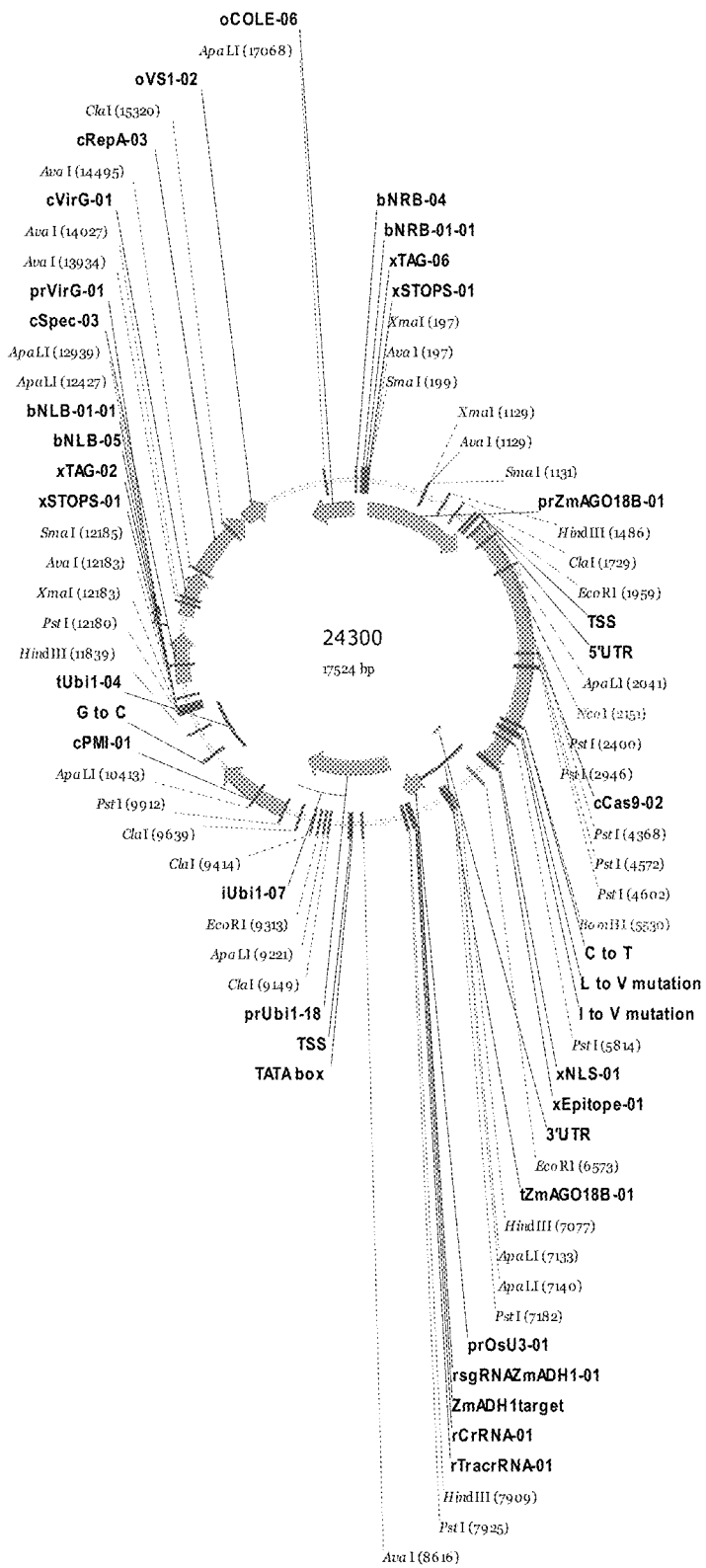
Figure 11 (Vector 24300)

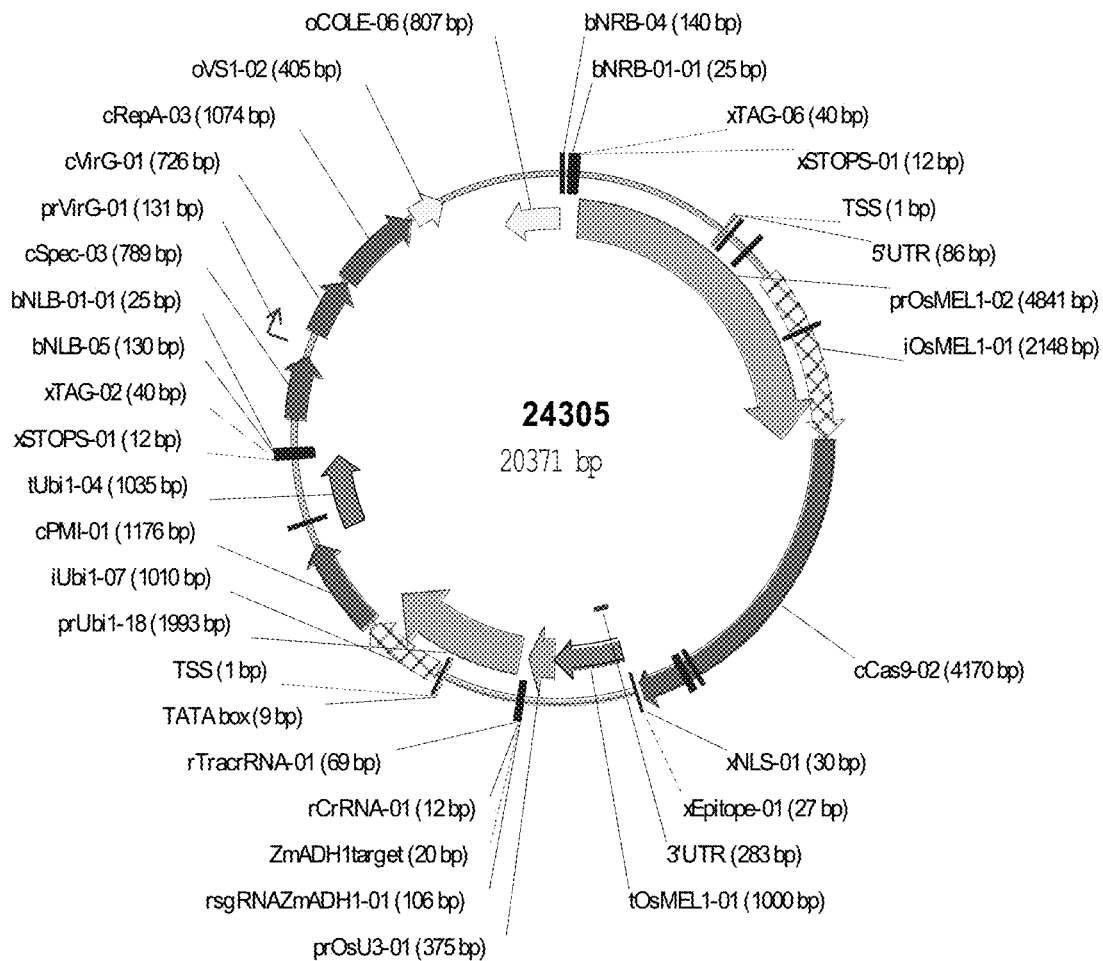
Figure 12 (Vector 24305)

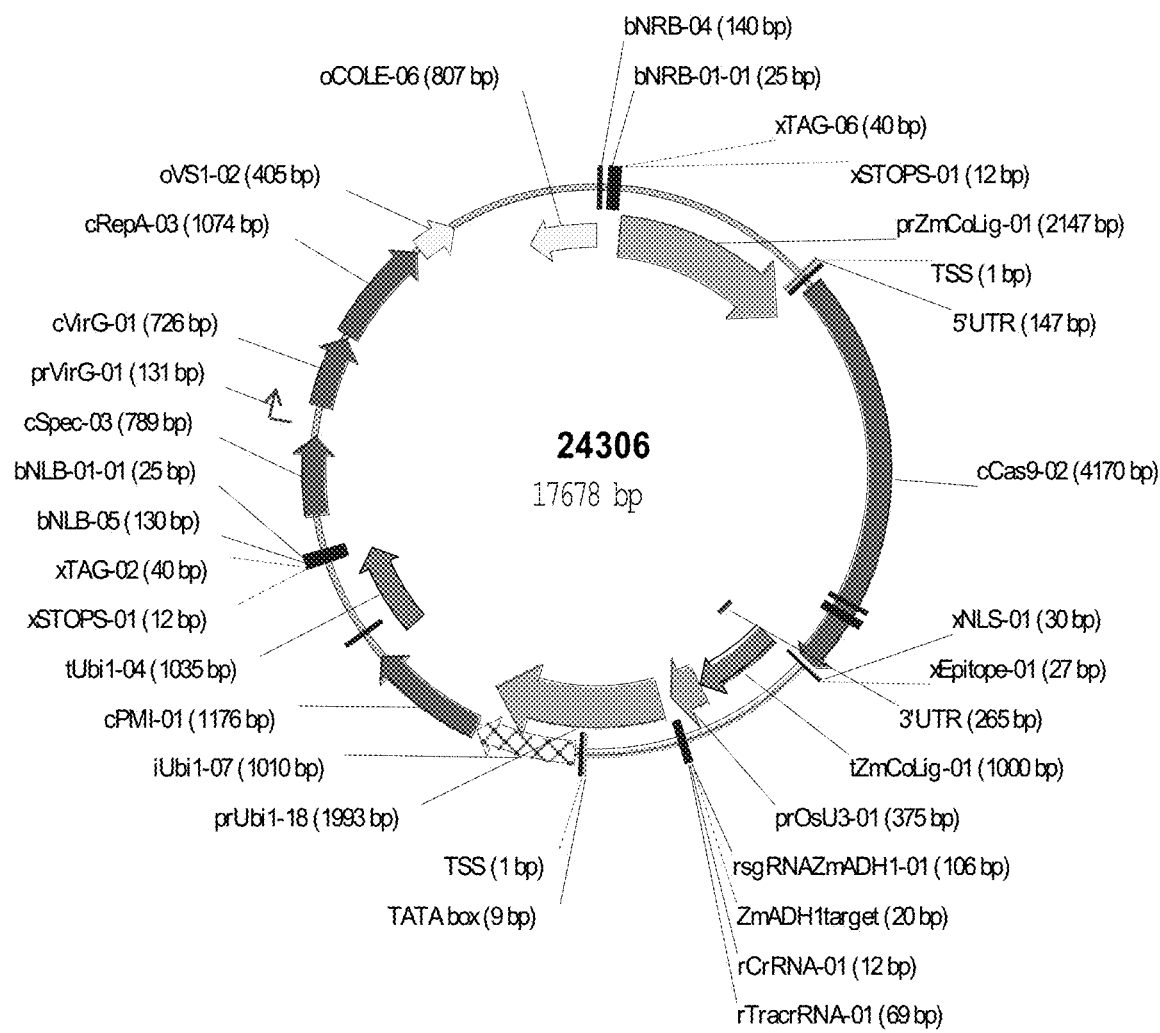
Figure 13 (Vector 24306)

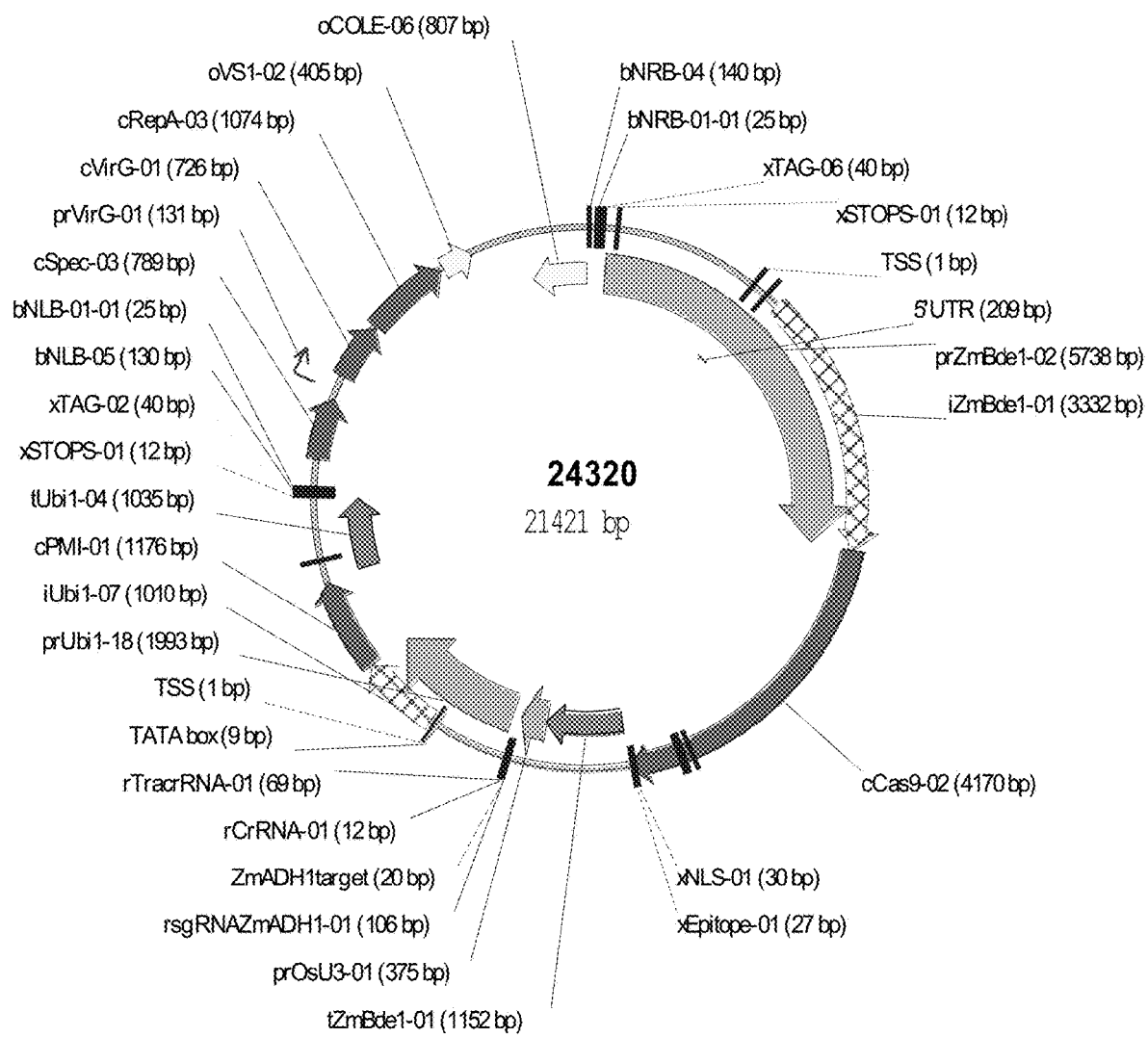
Figure 14 (Vector 24320)

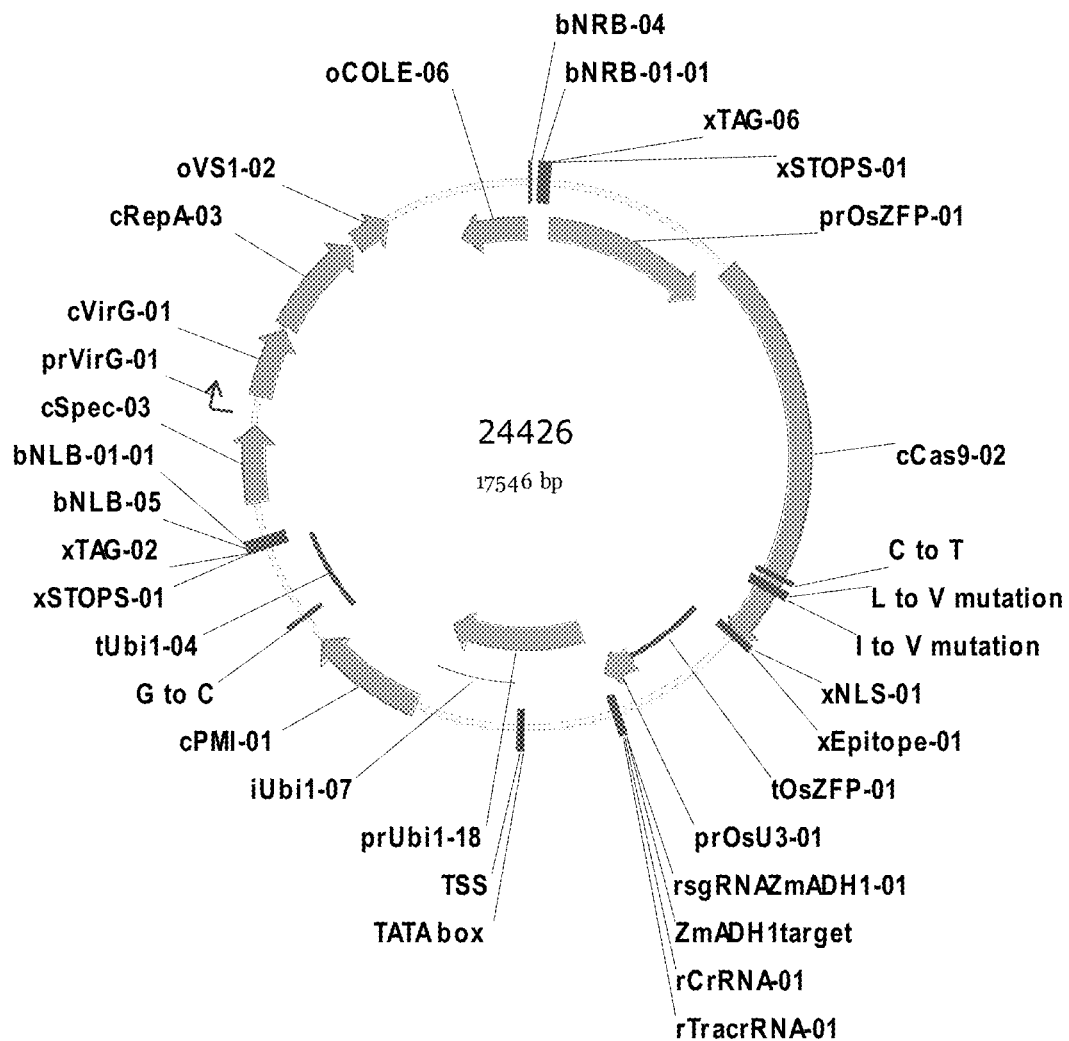
Figure 15 (Vector 24426)

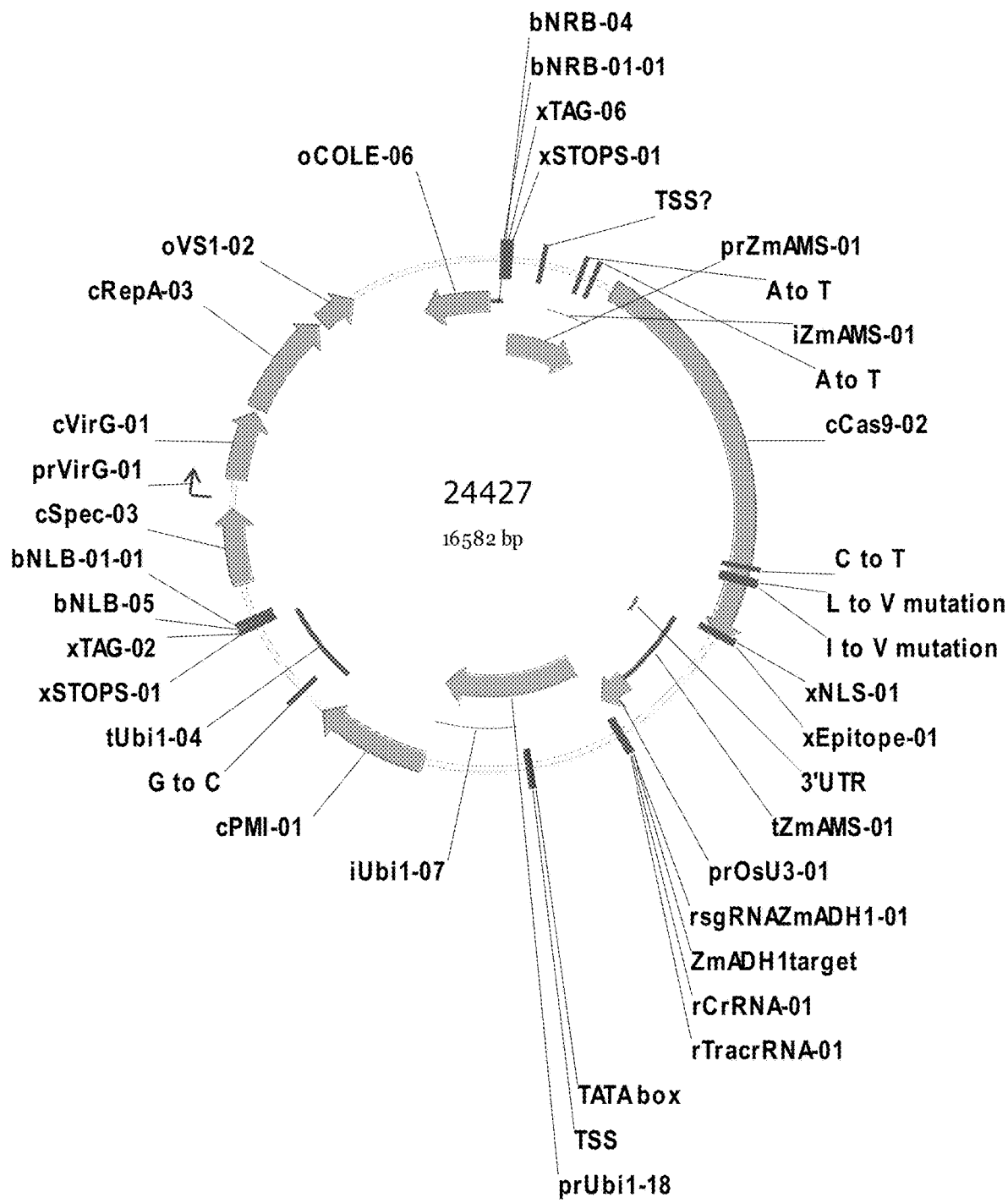
Figure 16 (Vector 24427)

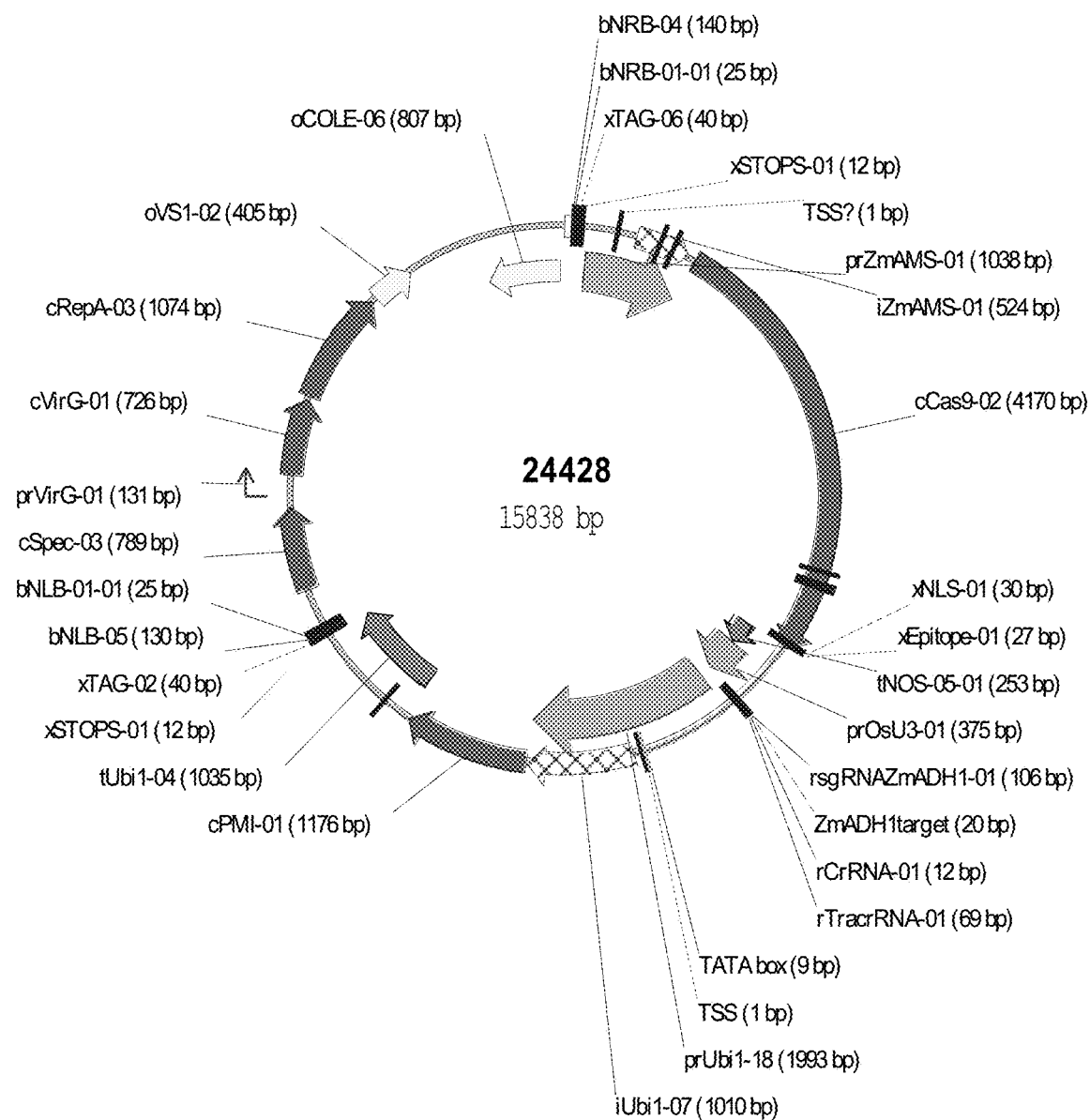
Figure 17 (Vector 24428)

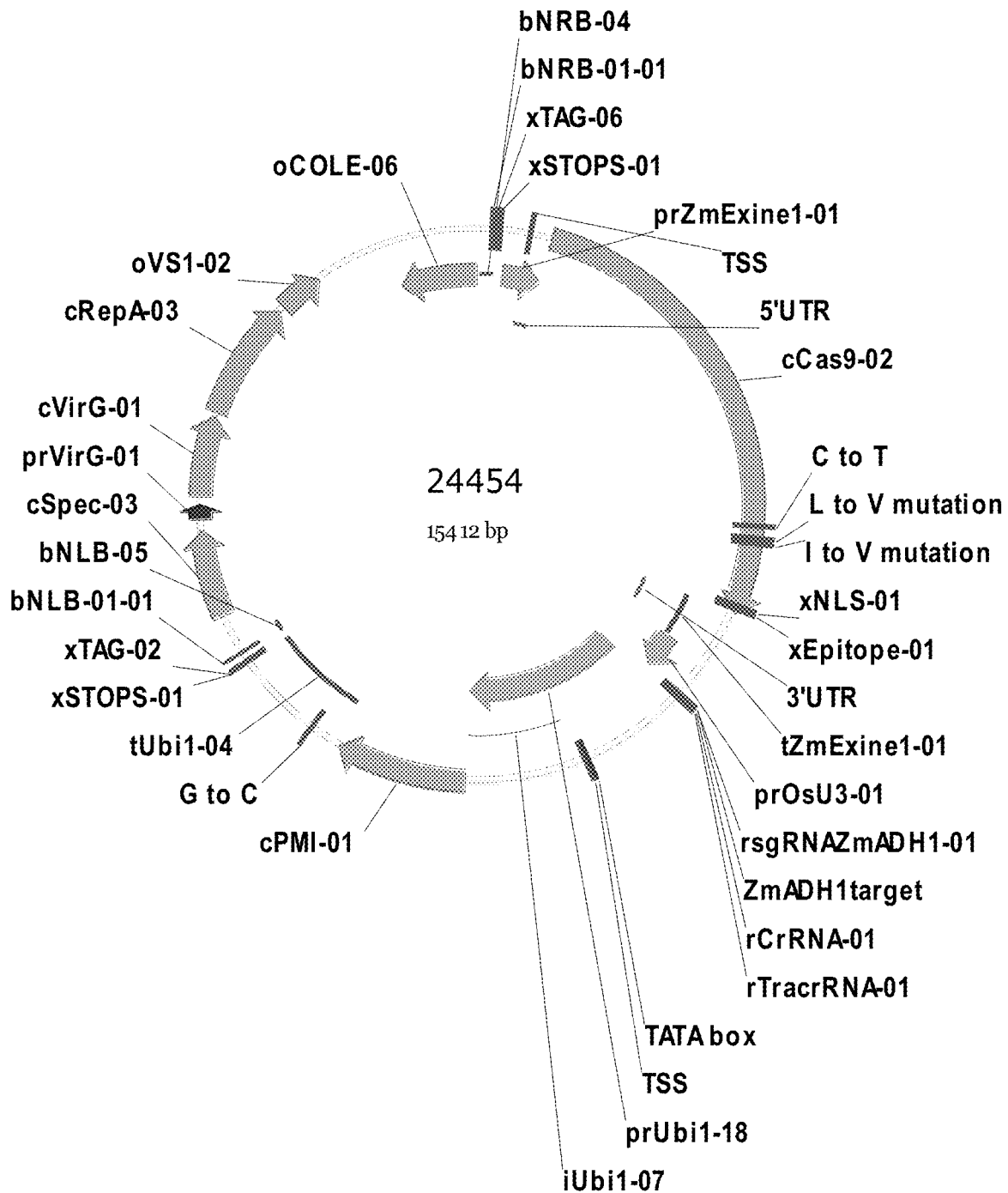
Figure 18 (Vector 24454)

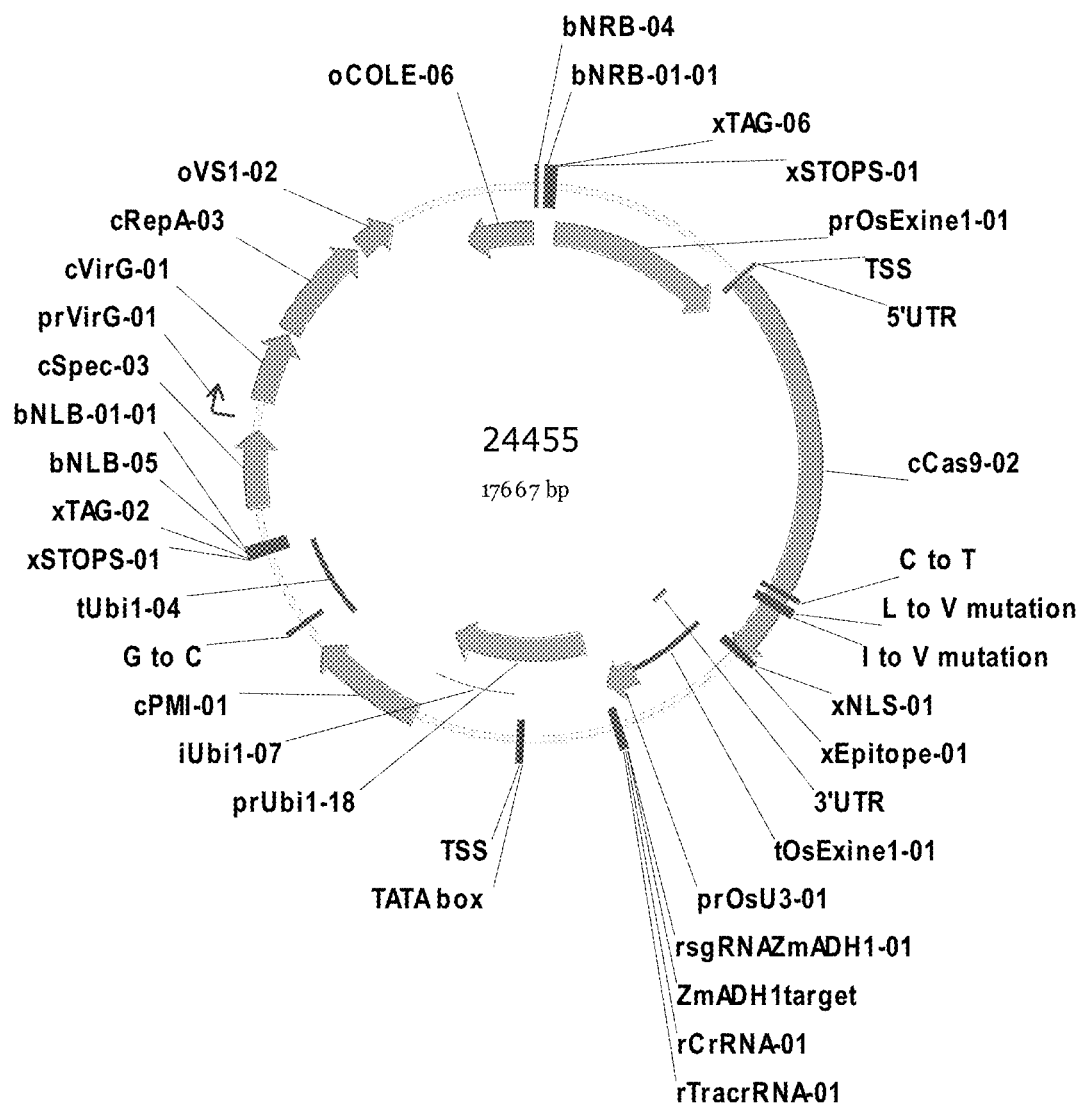
Figure 19 (Vector 24455)

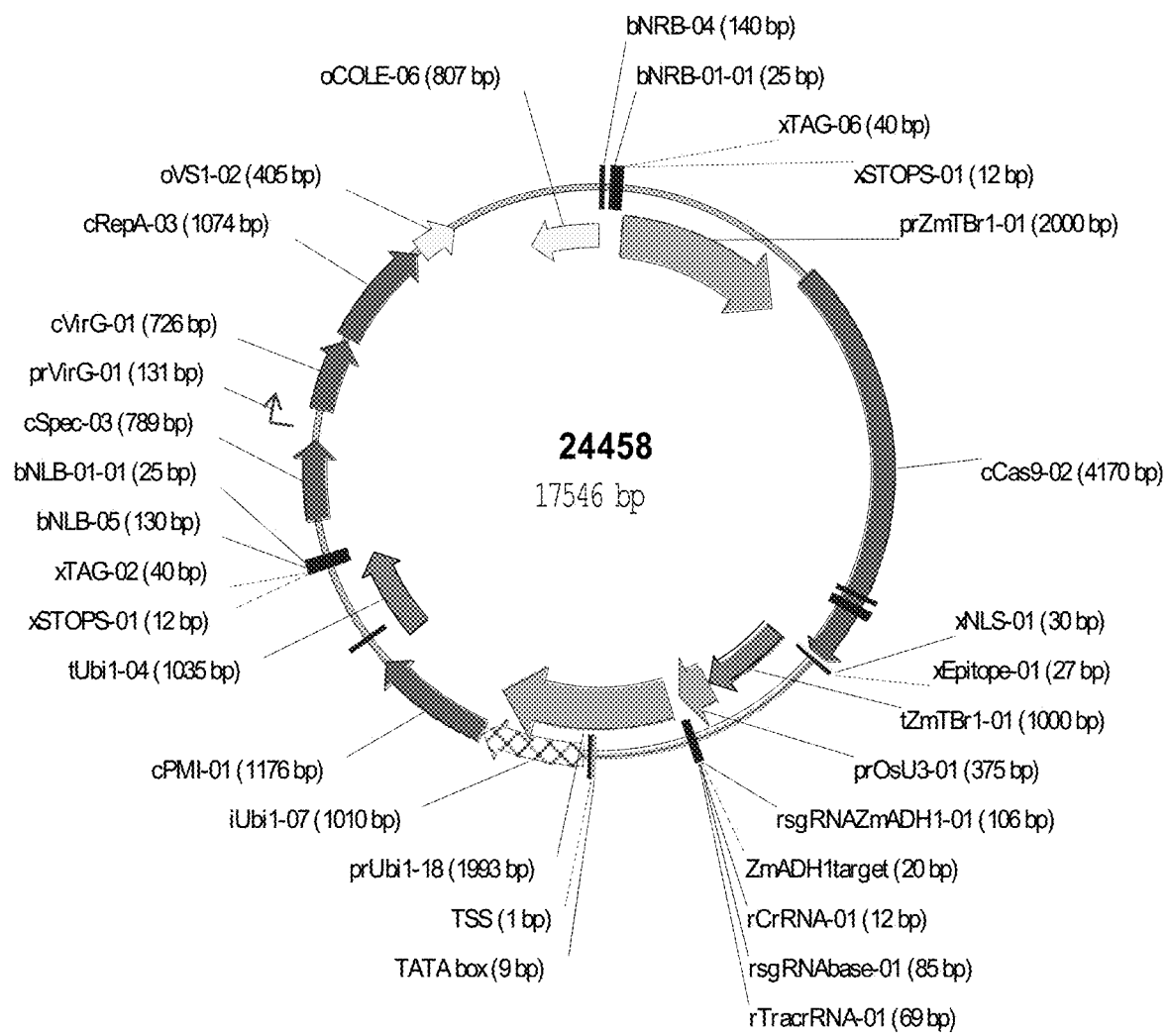
Figure 20 (Vector 24458)

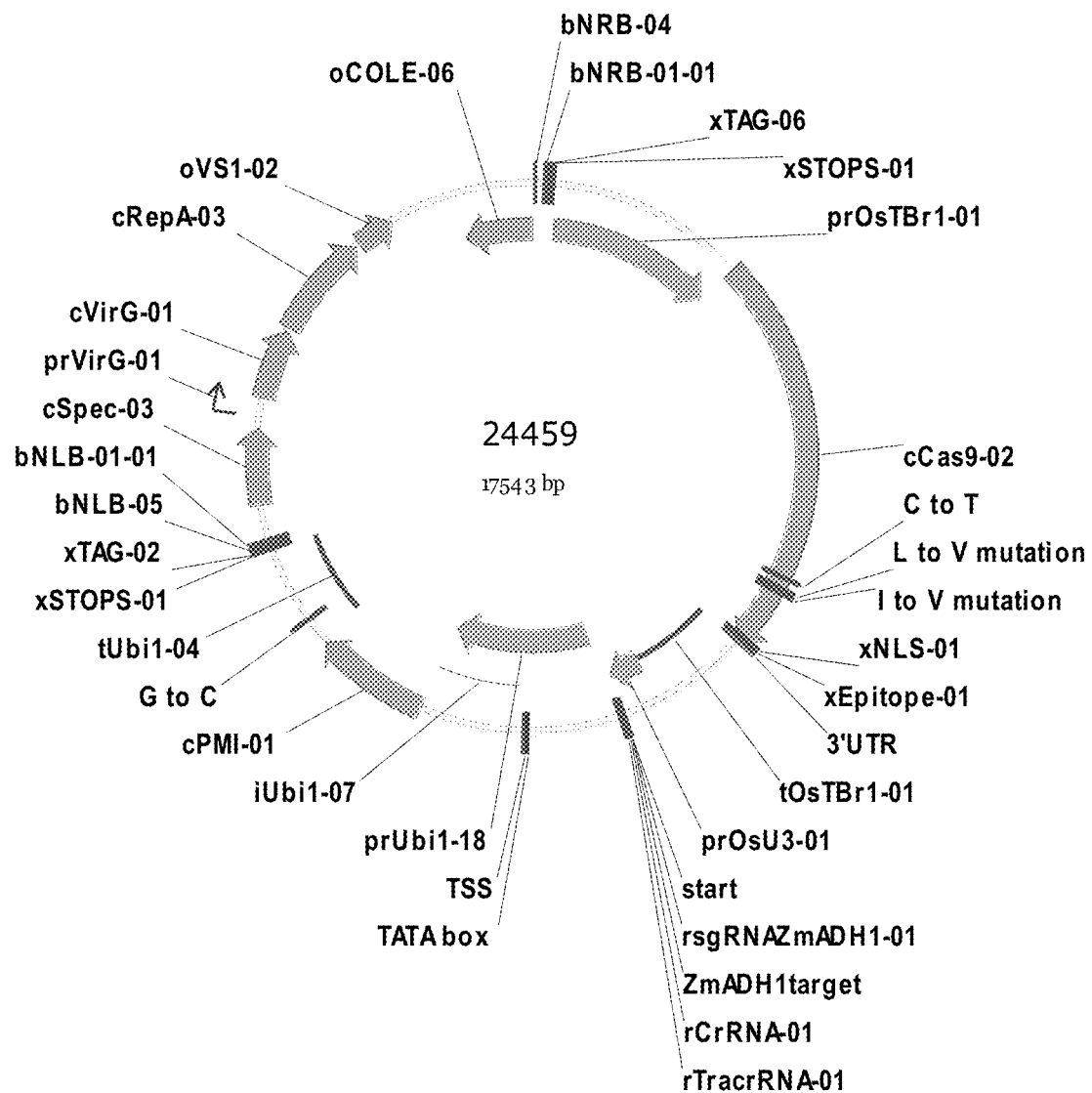
Figure 21 (Vector 24459)

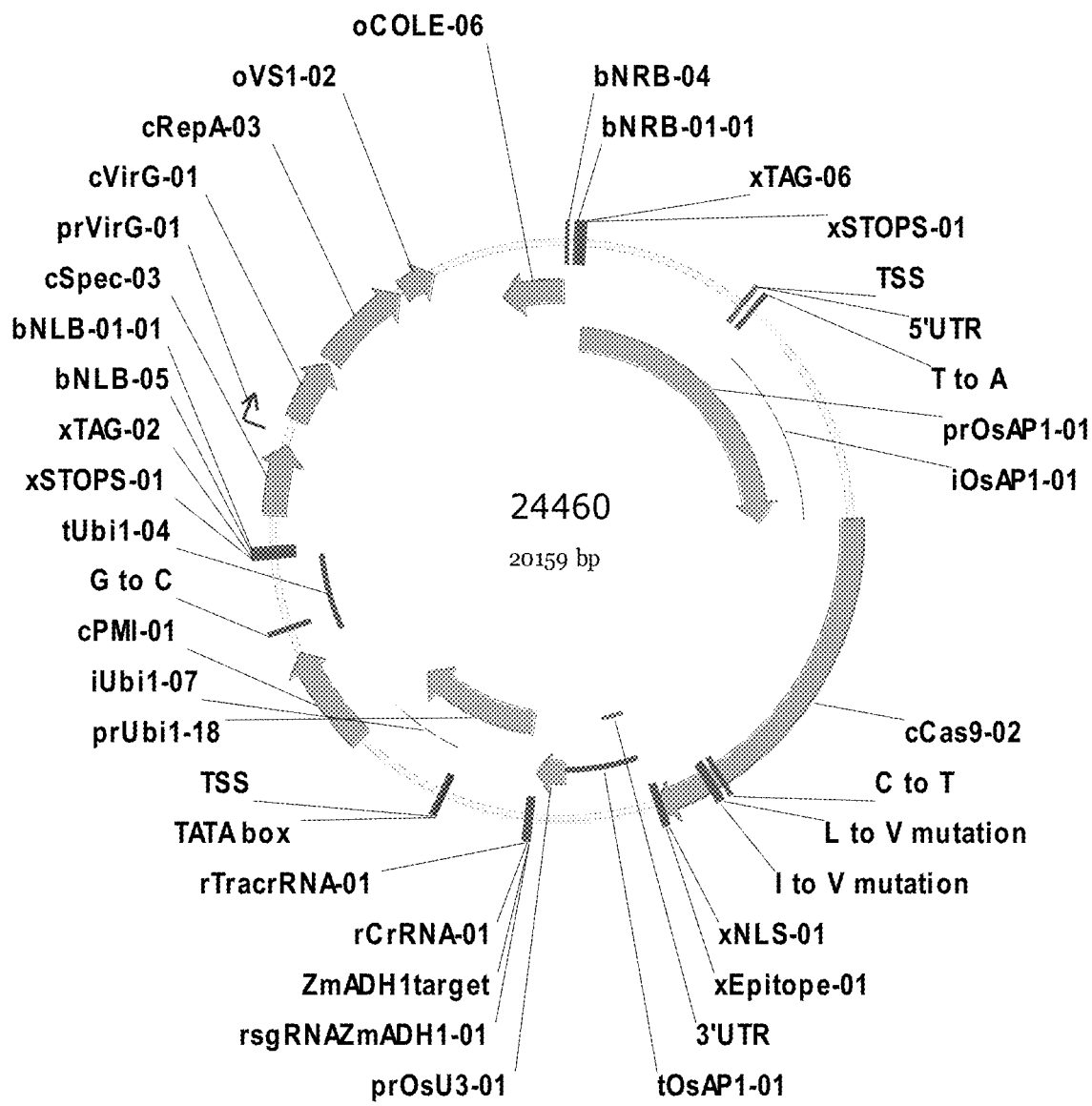
Figure 22 (Vector 24460)

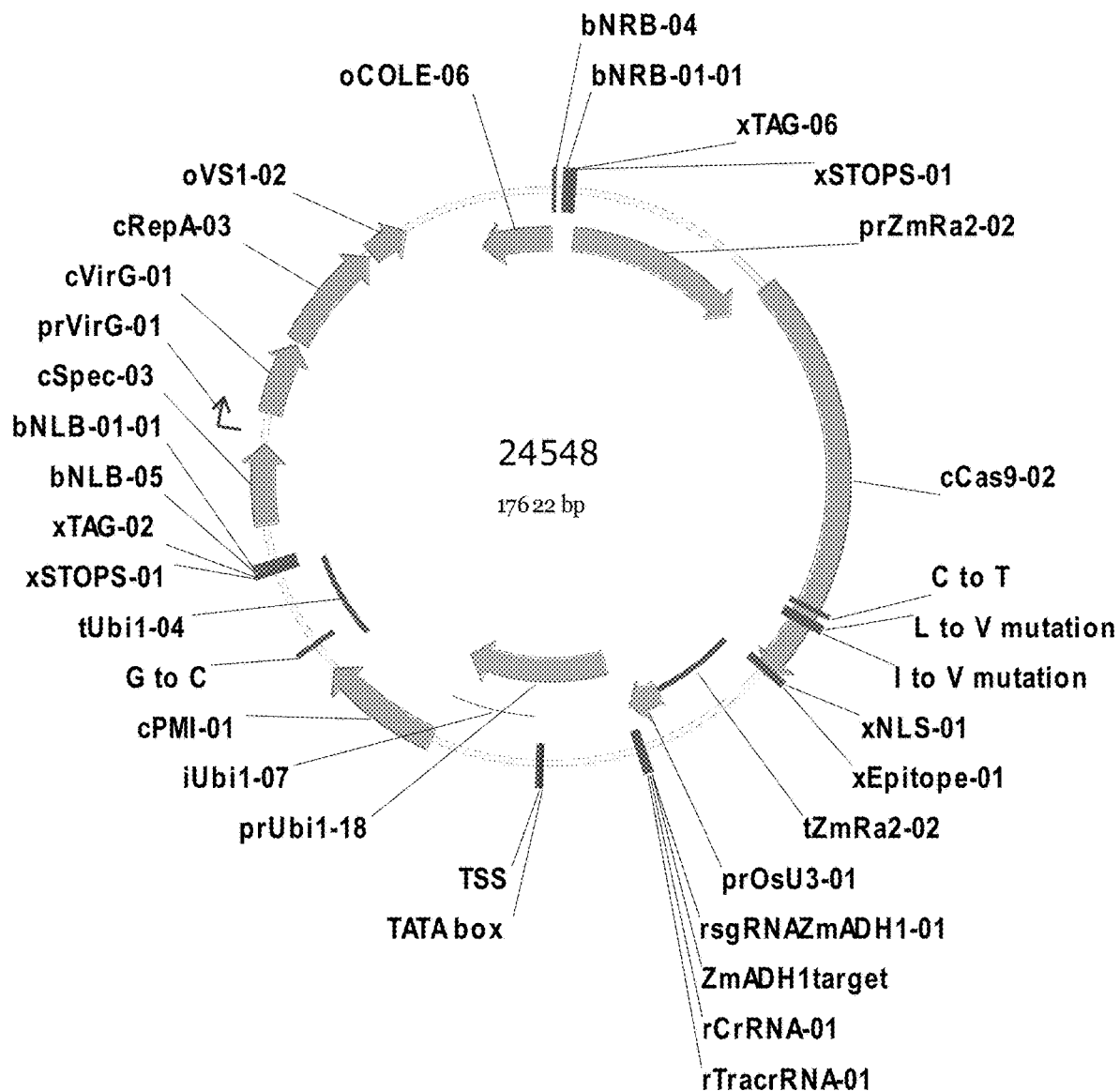
Figure 23 (Vector 24548)

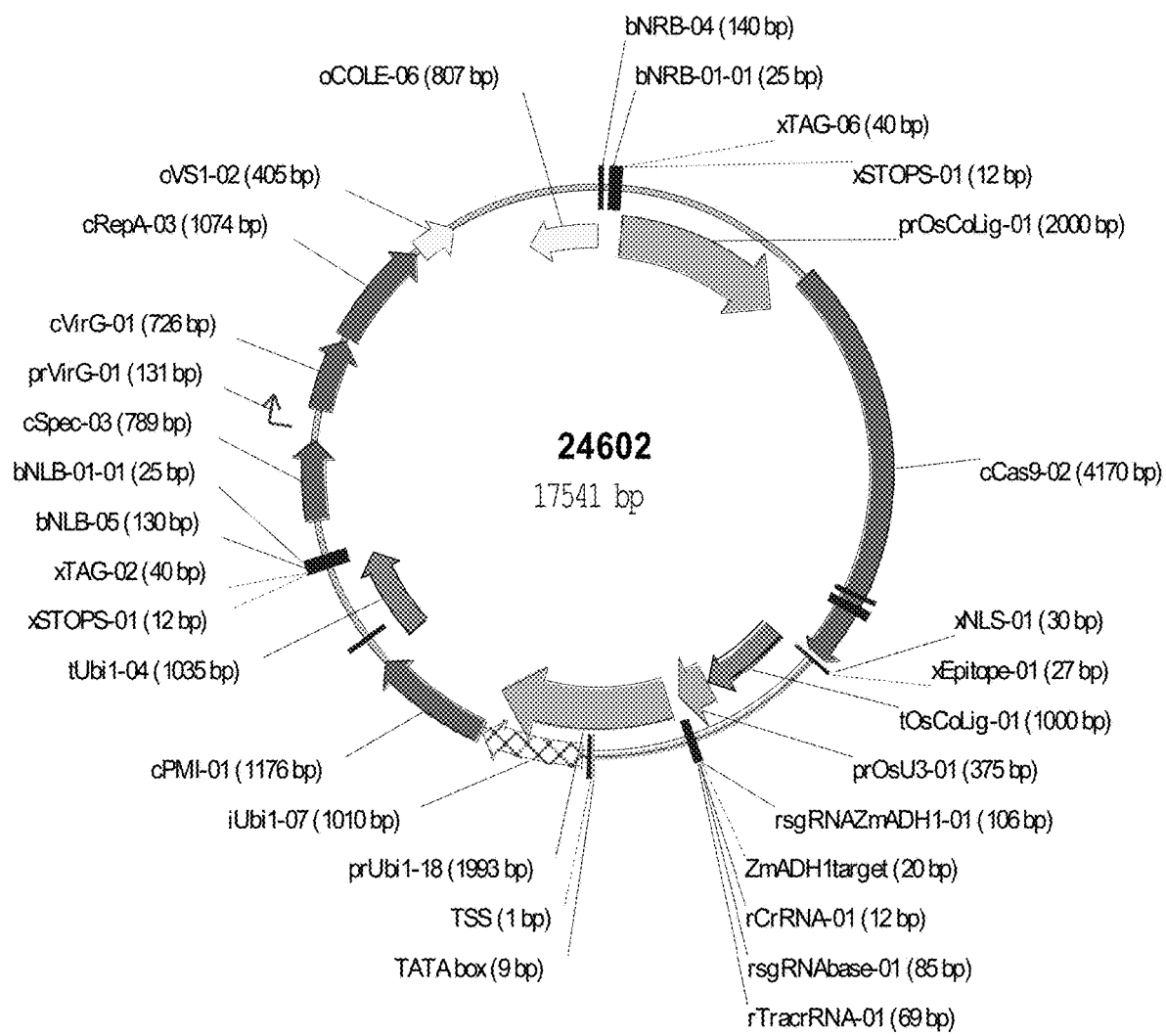
Figure 24 (Vector 24602)

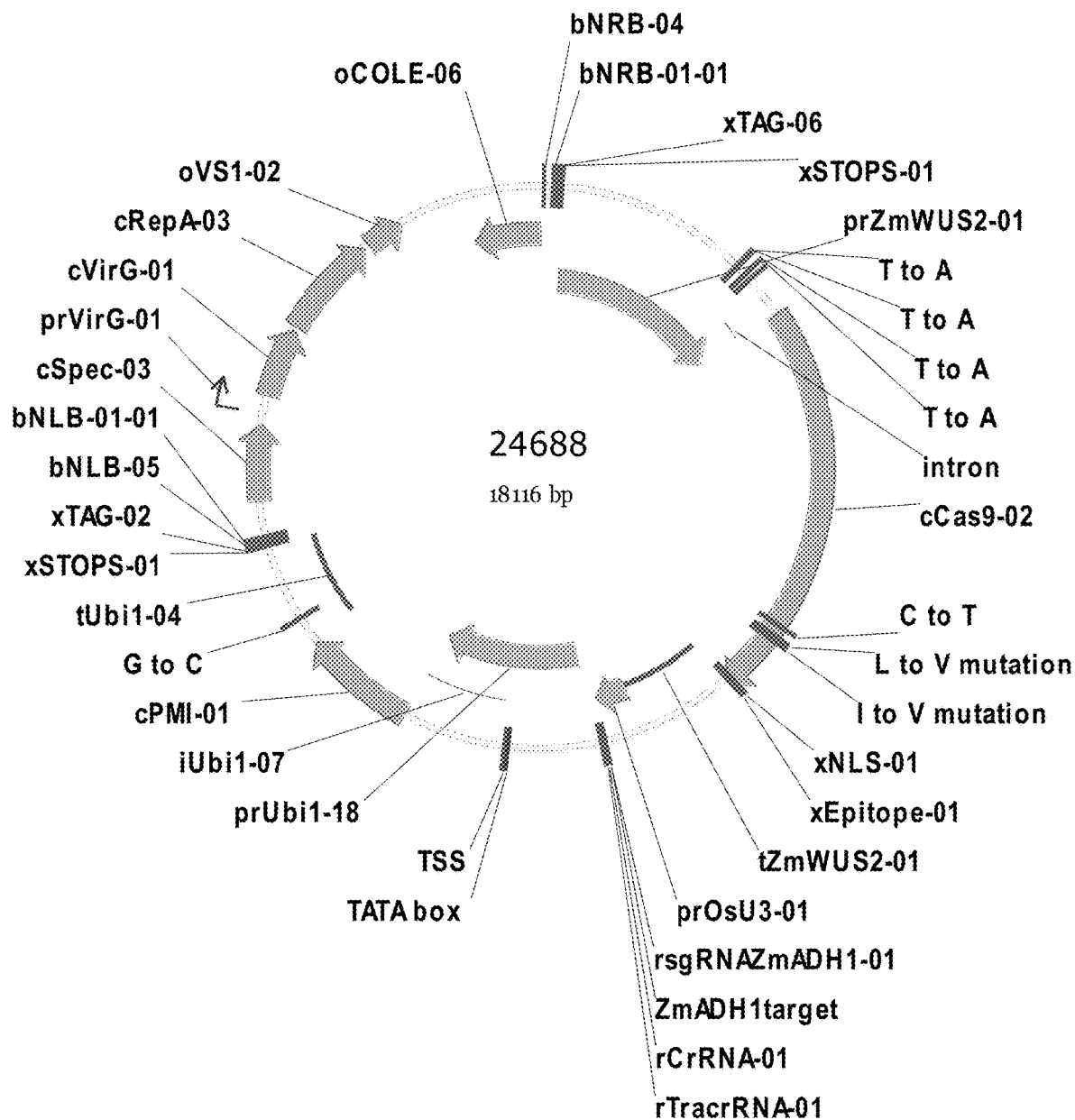
Figure 25 (Vector 24688)

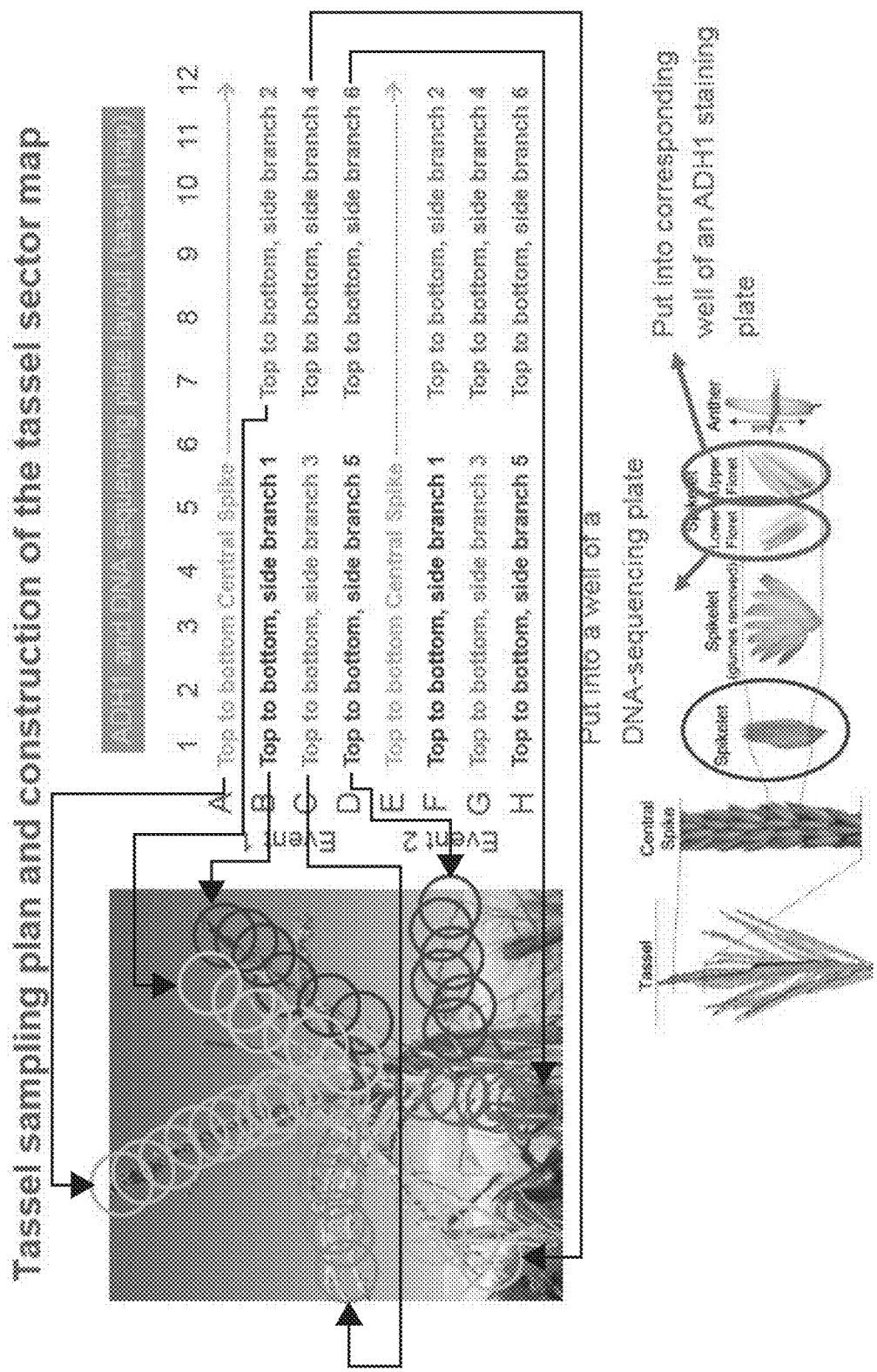
Figure 26 [Tassel sampling plan]

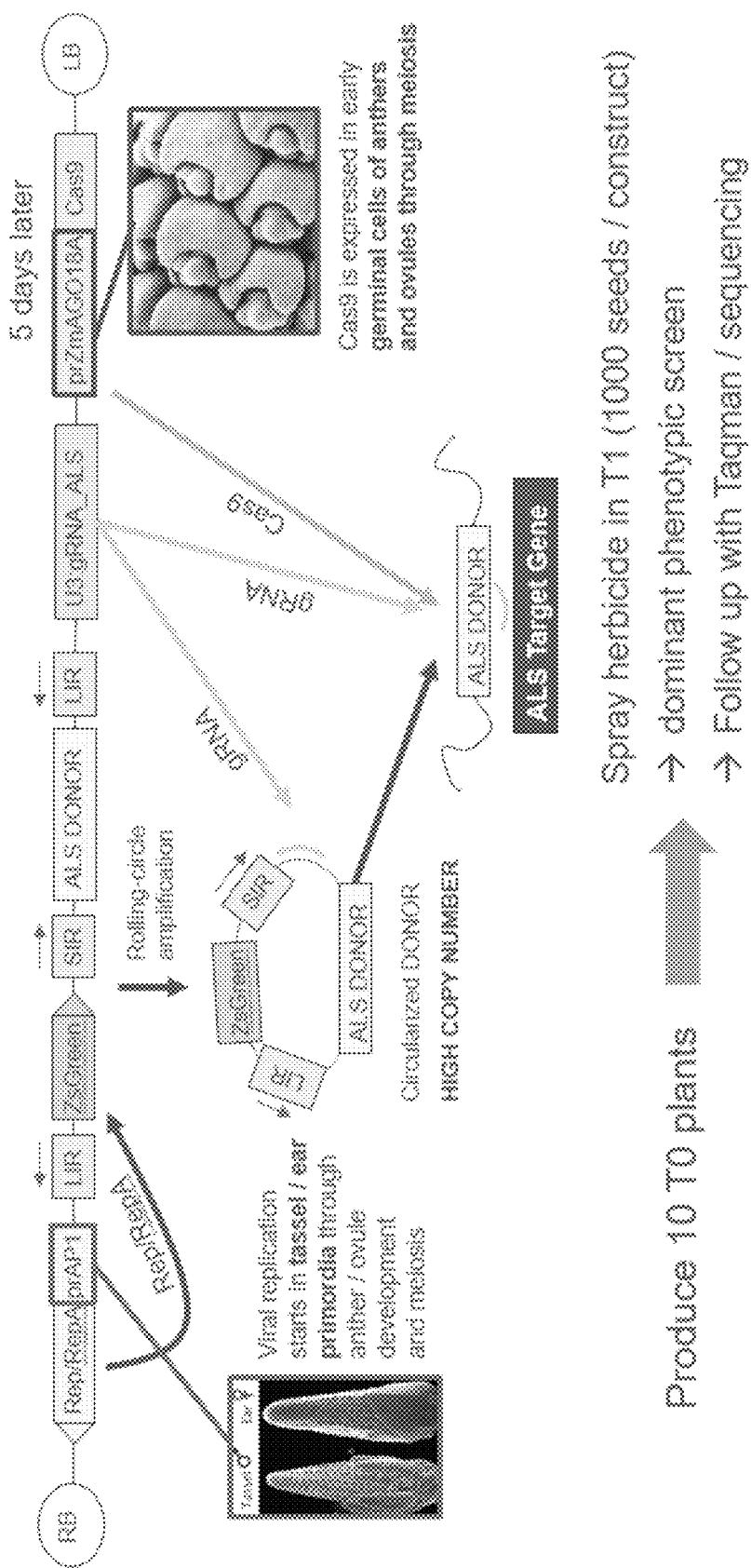
Figure 27 [One guide RNA target flanking donor]

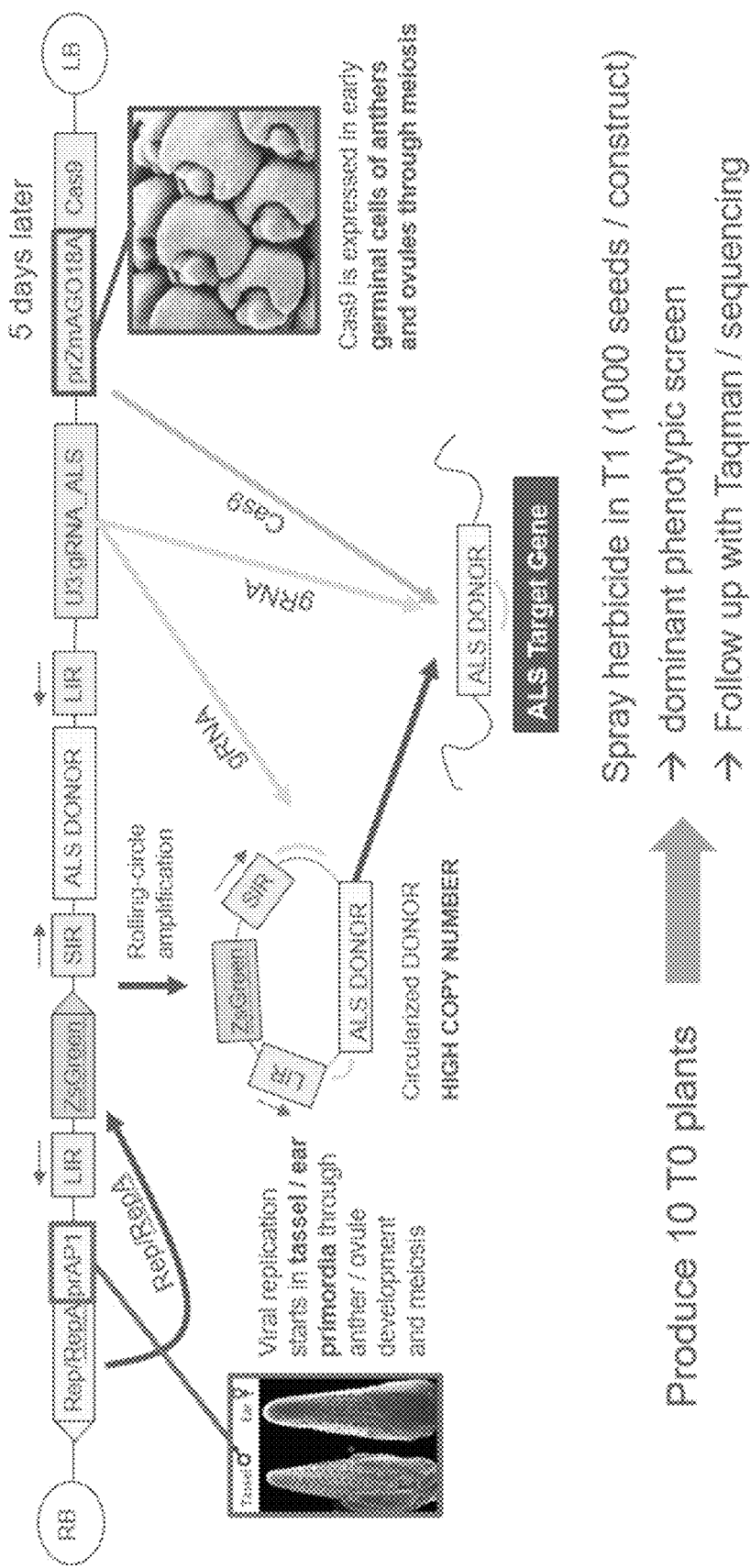
Figure 28 [2 gRNA flanking Donor]

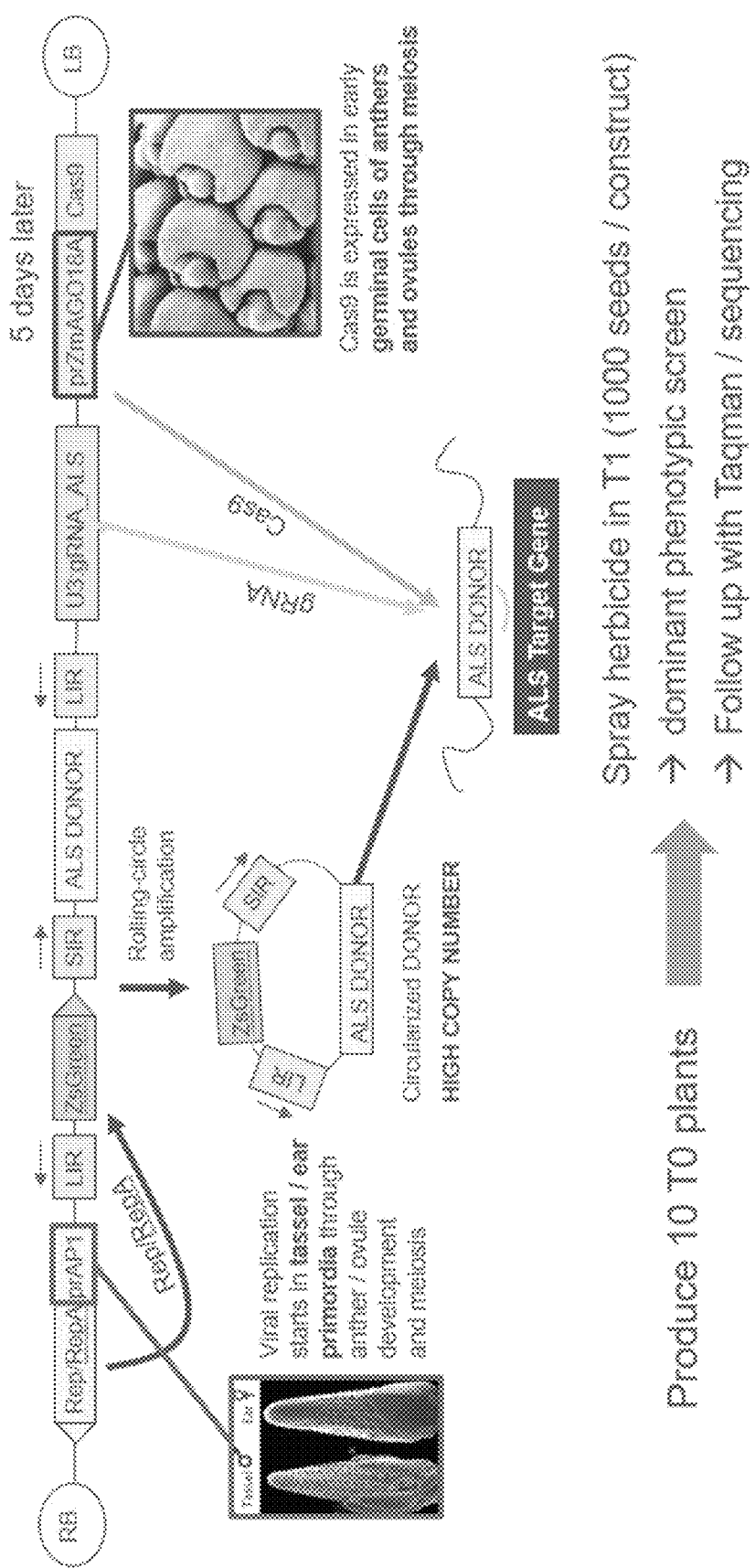
Figure 29 [no gRNA]

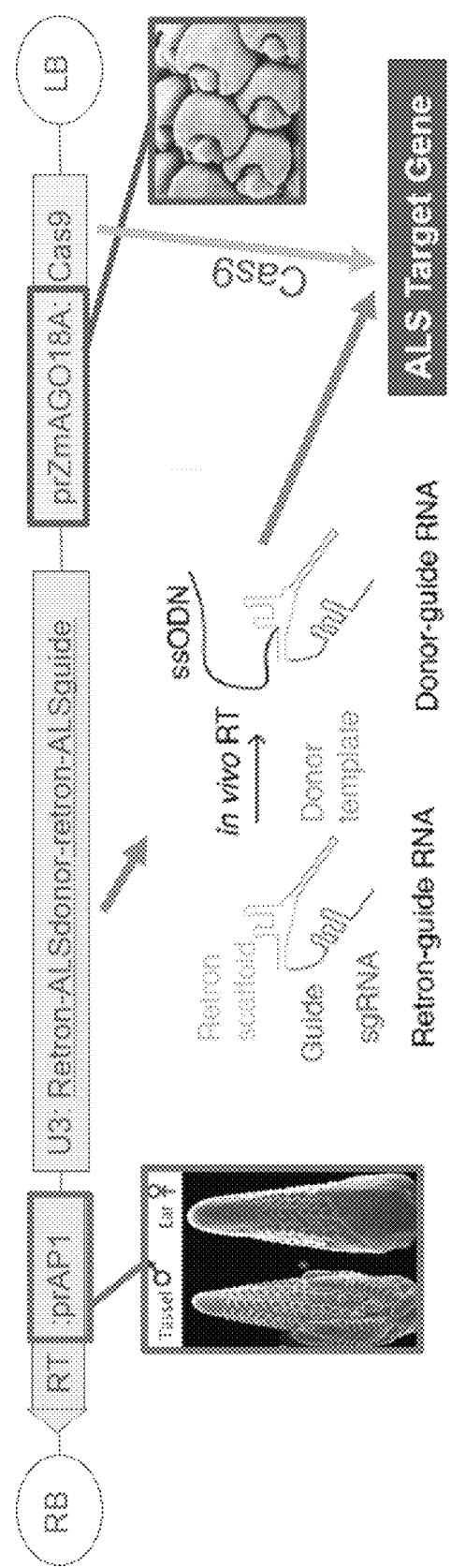
Figure 30 [Retron]

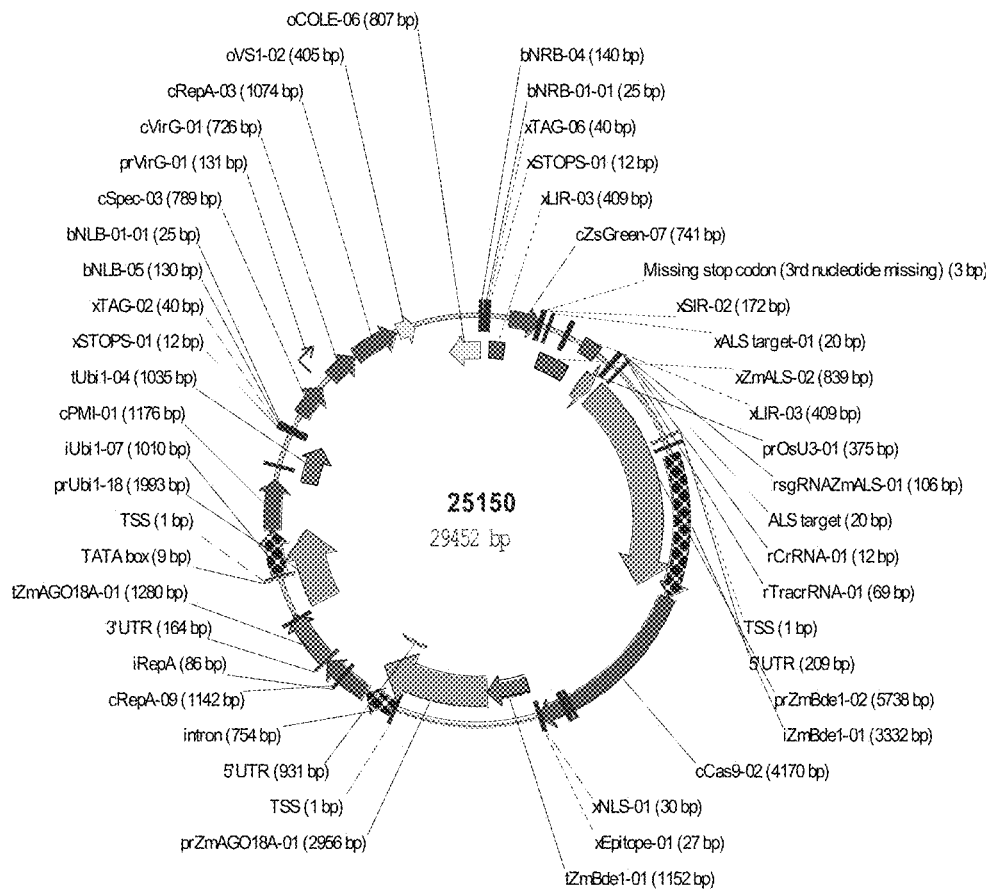
Figure 31 (Vector 1 AR-SDN2_REP_1Cut )

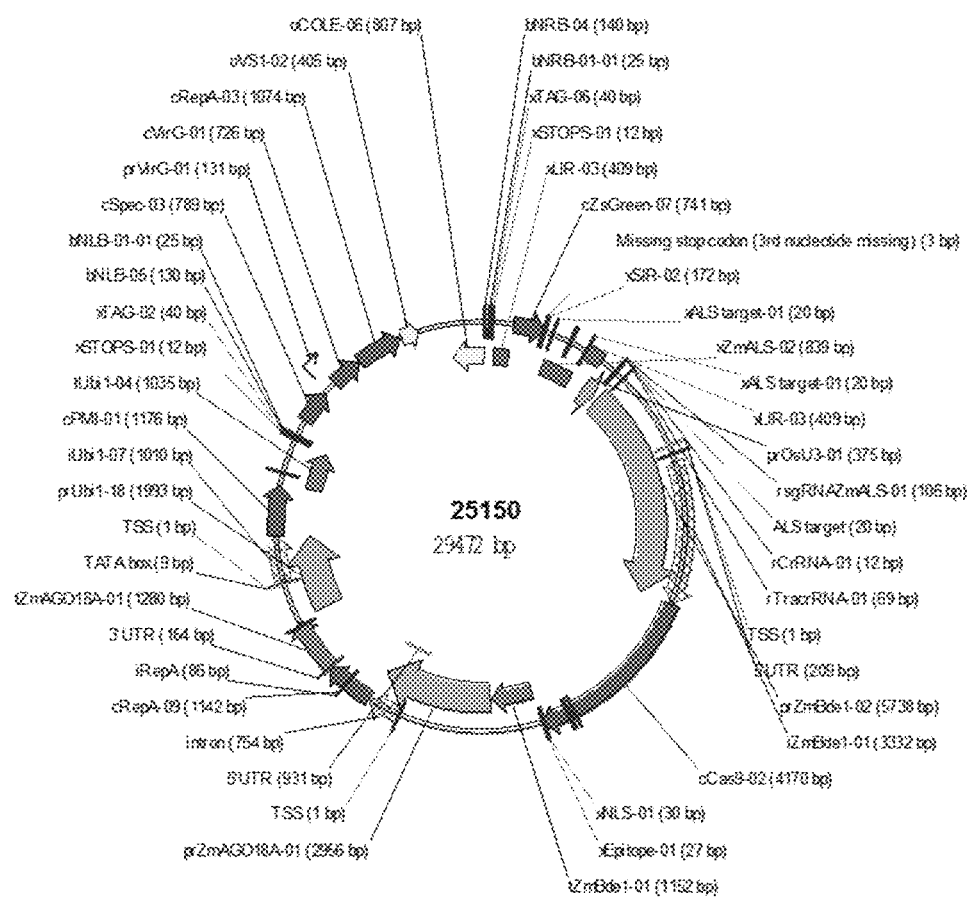
Figure 32 (Vector AR-SDN2_REP_2Cut)

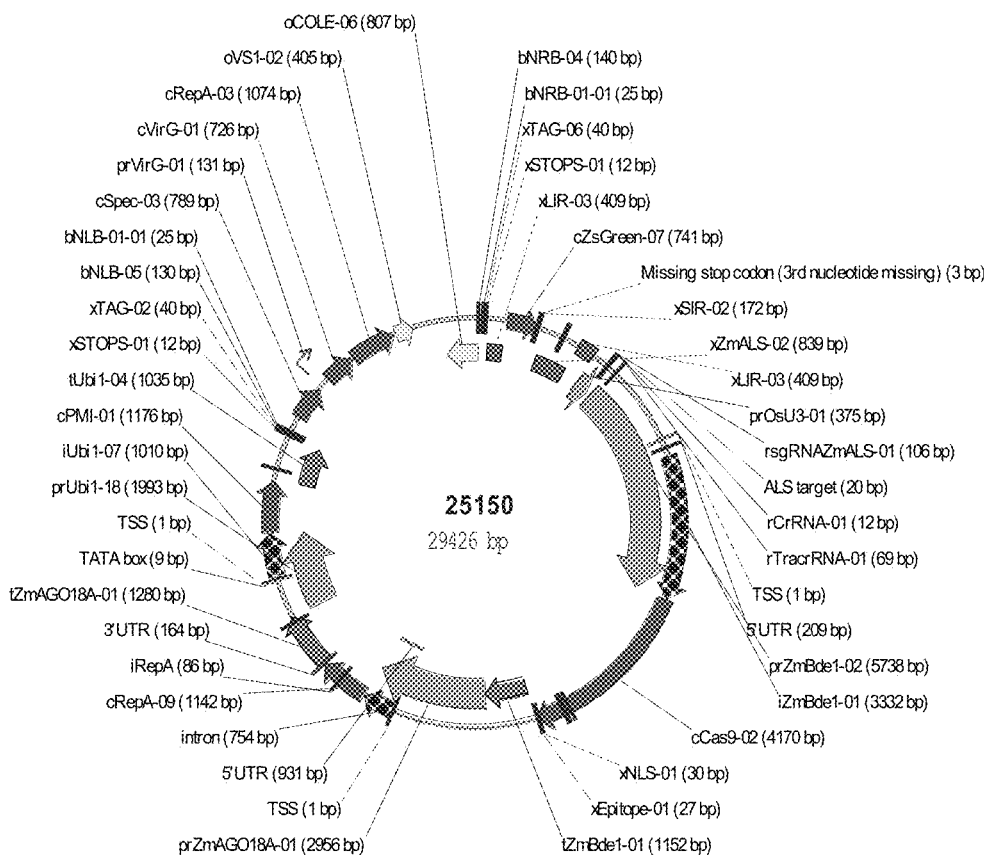
Figure 33 (Vector AR-SDN2_REP_NoCut)

| | | |
|---|---|---|
| WT | AGGCTCAGGGAAGGAAGAAGAGGCGC-AATAGGTCGGGAACTGTGGCGCTTCGTGAGA | |
| Edit 1 | AGGCTCAGGGAAGGAAGAAGAGGCGCAAATAGGTCGGGAACTGTGGCGCTTCGTGAGA | InsA |
| Edit 2 | AGGCTCAGGGAAGGAAGAAGAGGCGC---TAGGTCGGGAACTGTGGCGCTTCGTGAGA | ΔAA |
| Edit 3 | AGGCTCAGGGAAGGAAGAAGAGG----------------CGCTTCGTGAGA | Δ22nt |
| Edit 4 | AGGCTCAGGGAAGGAAGAAGAGG------TAGGTCGGGAACTGTGGCGCTTCGTGAGA | ΔCGCAA |
| Edit 5 | AGGCTCAGGGAAGGAAGAA---------TAGGTCGGGAACTGTGGCGCTTCGTGAGA | Δ9nt |
| Edit 6 | AGGCTCAGGGAAGGAAGAAGAGGCGCGAATAGGTCGGGAACTGTGGCGCTTCGTGAGA | InsG |
| Edit 7 | AGGCTCAGGGAAGGAAGAAGAGGCGC------GTCGGGAACTGTGGCGCTTCGTGAGA | ΔAATAG |
| Edit 8 | AGGCTCAGGGAAGGAAGAAGAGGC--AATAGGTCGGGAACTGTGGCGCTTCGTGAGA | ΔGC |
| Edit 9 | AGGCTCAGGGAAGGAAGAAGAGGC---ATAGGTCGGGAACTGTGGCGCTTCGTGAGA | ΔGCA |
| Edit 10 | AGGCTCAGGGAAGGAAGAAGAGG---AATAGGTCGGGAACTGTGGCGCTTCGTGAGA | ΔCGC |

Figure 40

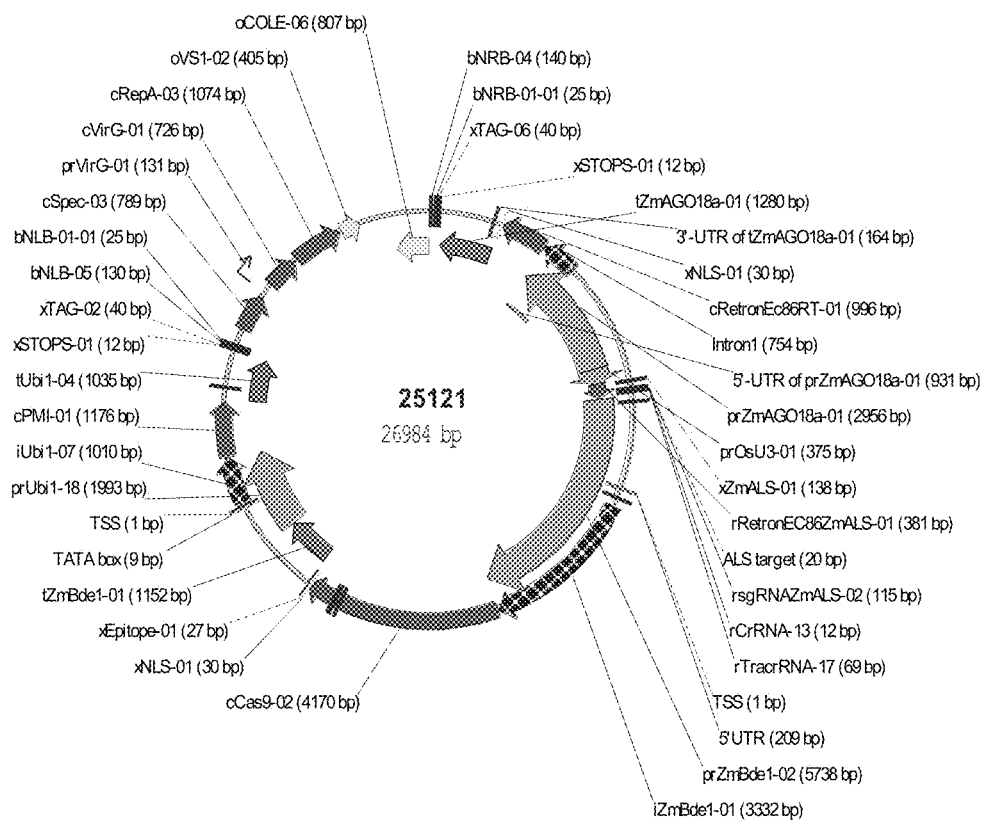
Figure 44 (AR-SDN2_RETRON)

COMPOSITIONS AND METHODS FOR DRIVING T1 EVENT DIVERSITY

RELATED APPLICATION INFORMATION

This application is a 371 of International Application No. PCT/US2020/019499 filed 24 Feb. 2020, which claims priority to PCT/CN2019/076062 filed 25 Feb. 2019, the contents of which are incorporated herein by reference herein.

STATEMENT REGARDING ELECTRONIC SUBMISSION OF A SEQUENCE LISTING

A Sequence Listing in ASCII text format, submitted under 37 C.F.R. § 1.821, entitled "1-81776-WO-P2_Seq_Final-17April2020_ST25.txt", ~1.6 MB in size, generated on Apr. 17, 2020 and filed via EFS-Web is provided in lieu of a paper copy. This Sequence Listing is hereby incorporated by reference into the specification for its disclosures.

BACKGROUND

The development of scientific methods to improve the quantity and quality of crops is a crucial endeavor. Gene editing, e.g. through targeted mutagenesis, insertion events, allele replacement, etc., is a very important technology widely used to improve both the quantity and quality of various crops. There are numerous methods to edit specific gene targets now, including clustered regularly interspaced short palindromic repeats (CRISPR) and CRISPR-associated sequence (Cas) enzymes, transcription activator-like effector nuclease (TALEN), meganucleases, and zinc fingers. But gene editing is not always an easy task.

Edits to turn off a gene's function (commonly called "knockouts") can be accomplished relatively easily by genome editing. Through use of a site-directed nuclease, such as a Cas9 enzyme and an associated CRISPR guide RNA (gRNA), one can easily create small insertions or deletions ("indels") in the coding sequence of a target gene, which frequently lead to frameshifts that truncate the protein or generate an aberrant sequence. In contrast to these well-known methods to knock out a gene, it can be very labor intensive to achieve other types of edits, such as edits that induce a partial loss-of-function or a gain of function allele, or edits that alter the expression level of a gene or the function of the protein product. Many of these edits require allele replacement, which is quite inefficient. Likewise, edits to delete an entire exon or gene or chromosome region (large deletions) can be challenging to execute because they may require simultaneous cutting of more than one gRNA target site. Similarly, edits to introduce a SNP—changing a cytosine nucleotide to a thymine nucleotide, for instance, can utilize 'base editing' technology, but only within certain windows in relation to the targeting site. These are just a few examples of where the desired editing outcome will be challenging to obtain, due to the lack of perfect specificity or efficiency of the DNA modification enzyme system being used.

With respect to allele replacement (sometimes also called "allele swapping"), this is a method of editing that utilizes homologous recombination or homology directed repair, to replace an endogenous sequence in a plant cell with a new sequence that can be provided. While this is fairly easy to do in yeast and in many animal systems, it is very challenging to do in plants because the non-homologous end joining pathway is strongly favored for DNA repair. Additionally, this process requires delivery of abundant donor DNA to the cut site, to act as the template for DNA repair via homologous recombination. This delivery is not easy to accomplish, particularly for plants. For this reason, allele replacement in plants is typically incredibly expensive and labor intensive to achieve. For example, if one wishes to transform a plant and execute an allele replacement, one may need to generate one thousand stably transformed events to ensure that one allele swap is created in just one or two of the events. The efficiency is generally less than 1%, in some cases, between 0 and 0.3%. Even in the best crops, lines, and construct designs, the efficiency is still very low.

Applicant believes that the cost and labor intensity of generating allele replacements, large deletions, certain base edits, and various other editing outcomes has become a major bottleneck for plant breeding. Few methods have worked to alleviate the extremely low efficiency of the process. Accordingly, the current disclosure is directed to at least one of these, or additional, problems.

Outside of allele replacement, another major challenge for genome editing is the time and labor required to make a wide diversity of sequences (allelic diversity for a locus). For example, it can be quite time consuming and costly to create a diverse array of alleles for a gene's coding sequence, or to create expression diversity by modifying a gene's regulatory region (promoter). The current disclosure is also directed, in many embodiments, to cost-effective methods to produce an allelic series. These and other benefits will become apparent based on the detailed description below.

SUMMARY

The current disclosure is directed to, inter alia, systems, compositions, and methods to improve gene editing efficiencies, for example, to reduce the number of transformations required to generate a plurality of edits in a plant's DNA. In various embodiments, the disclosure is directed to methods for producing a plurality of unique edits in a plant's T1 seed, e.g. a plurality of unique allele replacements, a plurality of unique base insertions, a plurality of unique base deletions, and/or a plurality of unique base substitutions.

For example, methods comprise transforming at least one expression cassette into a plant cell or a plant tissue, wherein the at least one expression cassette comprises a nucleic acid that encodes a DNA modification enzyme; a floral mosaic (FMOS) regulatory sequence; and, optionally, a nucleic acid that encodes at least one guide RNA (gRNA). The FMOS regulatory sequence mediates expression of the DNA modification enzyme in at least one of a floral primordia cell and a floral reproductive organ (e.g. anther or carpel), and mediates a plurality of edits in the floral primordia cells and the floral reproductive organ. The plant cell or tissue is then grown, pollinated, and produces a plurality of T1 seed containing a plurality of unique edits. The FMOS regulatory sequence will include an FMOS promoter, and in some embodiments, further include an FMOS terminator.

Expression rates of the DNA modification enzyme may vary from embodiment to embodiment, but will be significant in at least one of the floral primordia and a floral reproductive organ, especially when compared to vegetative growth and mature seed. For example, expression rates will be at least 2× more in floral primordia and/or floral reproductive organs than in leaf tissue or shoot apical meristem (SAM), and at least 2× more in floral primordia and/or floral reproductive organs than in a seed or callus. More typically, expression rates will be even greater, e.g. at least 10×, at least 50×, at least 100×, at least 500× or event greater, e.g.

at least 1000× greater. Still, in some embodiments, there will be no expression in either or both of vegetative tissue or seed.

Using methods disclosed herein, a plurality of unique edits can be generated in the T1 seed. For example, seed in the T1 generation may contain at least 3, at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique edits.

The DNA modification enzyme selected may vary and may include, for example, a site-directed nuclease selected from the group consisting of a meganuclease (MN); a zinc-finger nuclease (ZFN); a transcription-activator like effector nuclease (TALEN); a Cas9 nuclease, a Cas12a (also referred to herein as "Cpf1"), Cas12b, Cas12i, Cas12h, etc. nuclease; a dCas9-FokI; a dCpf1-FokI; a chimeric Cas9- or Cas12a-cytidine deaminase; a chimeric Cas9- or Cas 12a-adenine deaminase (AID); a Cas9- or Cas12a EvolvR sequence (an error prone bacterial DNA polymerase I); a chimeric FEN1-FokI, and a Mega-TALs, a nickase Cas9 (nCas9), a chimeric dCas9 non-FokI nuclease and a dCas12a non-FokI nuclease.

When generating a plurality of unique allele replacements, the at least one expression cassette may also include additional components including a nucleic acid of interest, also referred to herein as "Donor DNA" to impart the desired allele. Additional features may be used to assist with replication of the Donor DNA, e.g. a Replicase (Rep or RepA) gene for driving replication of the Donor DNA. In many examples, the Donor DNA will be a component within a replicon, with the replicon including additional features, e.g. a Long Intergenic Region (LIR) of Wheat Dwarf Virus (WDV) and a Short Intergenic Region (SIR), e.g. derived from Wheat Dwarf Virus (WDV). The Rep/RepA initiates rolling circle amplification of the Donor DNA, which sits between the long intergenic region (LIR) and short intergenic region (SIR) of that same virus, where, for example, the movement and coat protein genes would normally be.

In some embodiments, the DNA modification enzyme is a Cas9 nuclease or a Cas12a nuclease and the at least one expression cassette comprises the nucleic acid that encodes a gRNA. The nucleic acid that encodes a gRNA is operably linked to the FMOS promoter or a second promoter. The at least one expression cassette may further comprises a nucleic acid of interest (Donor DNA) and be used for allele replacement editing. The at least one expression cassette may further comprise a replication promoter operably linked to the Donor DNA to drive replication of the Donor DNA.

Methods may further comprise growing the T1 seed to produce a plurality of T1 plants, measuring at least one phenotype in plants of the T1 generation, and selecting a plant of the T1 generation based on measured differences in phenotype driven by the unique edit. In some embodiments, methods may include sequencing the insertion site of the Donor DNA, INDEL, or SNP in the selected plant of the T1 generation, sequencing the insertion site of the Donor DNA, INDEL, or SNP of a non-selected plant of the T1 generation, and aligning the sequences. The selected plant having the unique edit may also be crossed with a plant not having the unique edit or selfed to produce progeny having the unique edit.

In another embodiment, a method for producing a plurality of unique edits in a plant's T1 seed comprises expressing in a floral primordia cell or a floral reproductive organ a nucleic acid that encodes a DNA modification enzyme and a nucleic acid that encodes a guide RNA (gRNA). At least one of the nucleic acid that encodes a DNA modification enzyme and the nucleic acid that encodes a gRNA is operably linked to a FMOS promoter. Plant tissue is then regenerated into a plant having a plurality of T1 seed, wherein the T1 seed contain a plurality of unique edits. In this example, the method may further include delivering a Donor DNA to the plant cell or the plant tissue where the expressing is performed, and inserting the Donor DNA into the DNA of the plant, e.g. to create an allele replacement with a gain of function or a replacement of function for example.

The current disclosure is also directed to various compositions to improve gene editing efficiencies. For example, one embodiment includes at least one expression cassette for producing unique edits in a plant's T1 seed. In this embodiment, the cassette comprises a nucleic acid that encodes a DNA modification enzyme, an optional a nucleic acid that encodes at least one guide RNA (gRNA), and a FMOS promoter. In another embodiment, the at least one expression cassette is contained within a vector.

In some embodiments, the disclosure provides methods and compositions for altering a target gene's expression in a plant's seed. Exemplary methods comprise a) transforming at least one expression cassette into a plant cell or a plant tissue, wherein the at least one expression cassette comprises a nucleic acid that encodes a DNA modification enzyme, a nucleic acid that encodes at least one guide RNA (gRNA), wherein the at least one guide RNA targets a regulatory region of the target gene, and a floral mosaic (FMOS) regulatory sequence, wherein the FMOS regulatory sequence (i) mediates expression of the DNA modification enzyme in at least one of a floral primordia cell and a floral reproductive organ, and (ii) mediates a plurality of edits in the regulatory region of the target gene in at least one of the floral primordia and the floral reproductive organ. The plant cell or pant tissue can be regenerated into a T0 plant having a plurality of T1 seed, wherein the T1 seed contain a plurality of unique edits in the regulatory region of the target gene, thereby creating a plurality of target gene expression profiles.

In some embodiments, the disclosure provides methods and compositions for creating variable knock-out combinations in a gene regulatory network (GRN) having at least a first DNA encoding a first network member and a second DNA encoding a second network member. Exemplary methods comprise a) transforming at least one expression cassette into a plant cell or a plant tissue, wherein the at least one expression cassette comprises a nucleic acid that encodes a DNA modification enzyme, a nucleic acid that encodes a first guide RNA (gRNA) targeting the first DNA encoding the first network member, a nucleic acid that encodes a second guide RNA (gRNA) targeting the second DNA encoding the second network member, and a floral mosaic (FMOS) regulatory sequence, wherein the FMOS regulatory sequence (i) mediates expression of the DNA modification enzyme in at least one of a floral primordia cell and a floral reproductive organ, and (ii) mediates a plurality of edits in the at least one of the floral primordia and the floral reproductive organ. Plant cells or tissues can then be regenerated into a T0 plant having a plurality of T1 seed, wherein the T1 seed contain a plurality of unique knock-out combinations in the GRN.

In some embodiments, the disclosure provides methods and compositions for producing a plurality of unique point mutations in a plant's T1 seed. Exemplary methods comprise a) transforming at least one expression cassette into a plant cell or a plant tissue, wherein the at least one expression cassette comprises a nucleic acid that encodes a catalytically dead Cas (dCas), a nucleic acid that encodes at least one guide RNA (gRNA) bearing an MS2 hairpin binding site, a nucleic acid that encodes a deaminase, and a floral mosaic (FMOS) regulatory sequence, wherein the FMOS regulatory sequence (i) mediates expression of the DNA modification enzyme in at least one of a floral primordia cell and a floral reproductive organ, and (ii) mediates a plurality of edits in the at least one of the floral primordia and the floral reproductive organ. Plant cells or tissues may be regenerated into a T0 plant having a plurality of T1 seed, wherein the T1 seed contain a plurality of unique point mutations. The dCas may vary from embodiment to embodiment and may include dead Cas9 (dCas9) or a dead Cas 12a (dCas12a) for example. An exemplary deaminase is an activation induced cytidine deaminase (AID).

In other embodiments, methods for producing a plurality of unique point mutations in a plant's T1 seed comprise a) transforming at least one expression cassette into a plant cell or a plant tissue, wherein the at least one expression cassette comprises a nucleic acid that encodes a nicking variant of Cas (nCas), a nucleic acid that encodes a DNA polymerase (Pol), a nucleic acid that encodes at least one guide RNA (gRNA), and a floral mosaic (FMOS) regulatory sequence, wherein the FMOS regulatory sequence (i) mediates expression of the nCas and the Pol in at least one of a floral primordia cell and a floral reproductive organ, and (ii) mediates a plurality of edits in the at least one of the floral primordia and the floral reproductive organ. Plant cells or tissues may be regenerated into a T0 plant having a plurality of T1 seed, wherein the T1 seed contain a plurality of unique point mutations. The nCas may be a nicking Cas9 (nCas9) or a nicking Cas 12a (nCas12a), which may be fused to the encoded Pol, for example. In many examples, the nCas is a nCas9 having a D10A mutation. In many examples, the Pol is an *E. coli* Pol, which may include at least one of the following mutations D424A, I709N and A759R.

In some embodiments, the disclosure provides compositions and methods for deleting a large intergenic region in a plant's T1 seed. Exemplary methods comprise a) transforming at least one expression cassette into a plant cell or a plant tissue, wherein the at least one expression cassette comprises a nucleic acid that encodes a RNA site-directed nuclease, a nucleic acid that encodes at least one first guide RNA (gRNA-1), a nucleic acid that encodes at least one second guide RNA (gRNA-2), wherein the gRNA-1 targets a first target sequence on a chromosome and wherein the gRNA-2 targets a second target sequence on the chromosome, wherein the first target sequence and the second target sequence are at least 0.1 Mb apart, and a floral mosaic (FMOS) regulatory sequence, wherein the FMOS regulatory sequence (i) mediates expression of the DNA modification enzyme in at least one of a floral primordia cell and a floral reproductive organ, and (ii) mediates a plurality of edits in the at least one of the floral primordia and the floral reproductive organ. Plant cells or tissue may be regenerated into a T0 plant having a plurality of T1 seed, wherein the T1 seed contain at least one large intergenic deletion. The size of the large intergenic region may vary from embodiment to embodiment. For example, the large intergenic region may include at least one region in the range of at least one of 0.1-2 Mb, 0.2-1.9 Mb, 0.3-1.8 Mb, 0.4-1.7 Mb, 0.5-1.6 Mb, 0.6-1.5 Mb, 0.7-1.4 Mb, 0.7-1.3 Mb, 0.7-1.2 Mb, 0.3-1.1 Mb, 0.3-1.0 Mb, 0.4-1.0 Mb, 0.5-1.0 Mb, and 0.6-0.8 Mb. Somewhat similarly, the distance between the first target sequence and the second target sequence may vary from embodiment to embodiment. For example, the first target sequence and the second target sequence may be separated by at least one distance in the range of at least one of 0.1-2 Mb, 0.2-1.9 Mb, 0.3-1.8 Mb, 0.4-1.7 Mb, 0.5-1.6 Mb, 0.6-1.5 Mb, 0.7-1.4 Mb, 0.7-1.3 Mb, 0.7-1.2 Mb, 0.3-1.1 Mb, 0.3-1.0 Mb, 0.4-1.0 Mb, 0.5-1.0 Mb, and 0.6-0.8 Mb. The nucleic acid that encodes gRNA-1 is operably linked to the FMOS promoter or a second promoter, and the nucleic acid that encodes gRNA-2 is operably linked to the FMOS promoter, to the second promoter, or to a third promoter.

In other embodiments, the disclosure provides additional compositions and methods for producing a plurality of unique edits in a plants T1 seed. Exemplary methods include a) transforming at least one expression cassette into a plant cell or a plant tissue, wherein the at least one expression cassette comprises a nucleic acid that encodes a RNA site-directed nuclease, a nucleic acid that encodes a guide RNA (gRNA), and a floral mosaic (FMOS) regulatory sequence comprising an FMOS promoter, wherein the FMOS regulatory sequence (i) mediates expression of the gRNA in at least one of a floral primordia cell and a floral reproductive organ, (ii) mediates a plurality of edits in the at least one of the floral primordia and the floral reproductive organ, (iii) mediates at least one of at least two-fold more expression, at least three-fold more expression, at least four fold-more expression, at least 5-fold more expression and at least six-fold more expression of the gRNA in the at least one of the floral primordia and the floral reproductive organ than in a shoot apical meristem (SAM), and (iv) mediates at least one of at least two-fold more expression, at least three-fold more expression, at least four fold-more expression, at least 5-fold more expression and at least six-fold more expression of the gRNA in the at least one of the floral primordia and the floral reproductive organ than in a seed. Plant cells or tissue may be regenerated into a plant having a plurality of T1 seed having a plurality of unique edits.

In some aspects, the disclosure provides a crop plant, or a seed thereof obtainable or obtained by the use or method of any of the embodiments described herein. In some aspects, the disclosure provides a plant cell comprising at least one expression cassette as disclosed herein.

The above summary was intended to summarize certain embodiments of the present disclosure. Embodiments will be set forth in more detail in the tables and description below. It will be apparent, however, that the particular description of specific embodiments is not intended to limit the scope of the present inventions.

BRIEF DESCRIPTION OF THE SEQUENCE LISTING

SEQ ID NO: 1 is a nucleotide sequence for vector 24301.
SEQ ID NO: 2 is the nucleotide sequence for promoter prZmAP1-01 in vector 24301.
SEQ ID NO: 3 is the nucleotide sequence for terminator tZmAP1-01 in vector 24301.
SEQ ID NO: 4 is the nucleotide sequence for cCas9-02 in vector 24301.
SEQ ID NO: 5 is the nucleotide sequence for rsgRNAZmADH1-01 in vector 24301.
SEQ ID NO: 6 is the nucleotide sequence for ZmADH1target in vector 24301.
SEQ ID NO: 7 is the nucleotide sequence for rCrRNA-01 in vector 24301.
SEQ ID NO: 8 is the nucleotide sequence for rTracrRNA-01 in vector 24301.
SEQ ID NO: 9 is the nucleotide sequence for promoter prOsU3-01 in vector 24301.

SEQ ID NO: 10 is a nucleotide sequence for vector 24224 (control).

SEQ ID NO: 11 is the nucleotide sequence for promoter_prCMP-04 in vector 24224.

SEQ ID NO: 12 is the nucleotide sequence for terminator tNOS-05-01 in vector 24224.

SEQ ID NO: 13 is the nucleotide sequence for Cas9 in vector 24224.

SEQ ID NO: 14 is the nucleotide sequence for rsgRNAZ-mADH1-01 in vector 24224.

SEQ ID NO: 15 is the nucleotides sequence for ZmADH1target in vector 24224.

SEQ ID NO: 16 is the nucleotides sequence for rCrRNA-01 in vector 24224.

SEQ ID NO: 17 is the nucleotide sequence for rTracrRNA-01 in vector 24224.

SEQ ID NO: 18 is the nucleotide sequence for promoter prOsU3-01 in vector 24224.

SEQ ID NO: 19 is a nucleotide sequence for vector 24265.

SEQ ID NO: 20 is the nucleotide sequence for promoter prZmBde1-01 in vector 24265.

SEQ ID NO: 21 is the nucleotide sequence for terminator tNOS-05-01 in vector 24265.

SEQ ID NO: 22 is a nucleotide sequence for vector 24266.

SEQ ID NO: 23 is the nucleotide sequence for promoter prZmBde1-01 in vector 24266.

SEQ ID NO: 24 is the nucleotide sequence for terminator tZmBde1-01 in vector 24266.

SEQ ID NO: 25 is a nucleotide sequence for vector 24269.

SEQ ID NO: 26 is the nucleotide sequence for promoter prZmAGO18A-01 in vector 24269.

SEQ ID NO: 27 is the nucleotide sequence for terminator tZmAGO18A-01 in vector 24269.

SEQ ID NO: 28 is a nucleotide sequence for vector 24270.

SEQ ID NO: 29 is the nucleotide sequence for promoter prZmAGO5B-01 in vector 24270.

SEQ ID NO: 30 is the nucleotide sequence for terminator tZmAGO5B-01 in vector 24270.

SEQ ID NO: 31 is a nucleotide sequence for vector 24289.

SEQ ID NO: 32 is the nucleotide sequence for promoter prZmAG5-02 in vector 24289.

SEQ ID NO: 33 is the nucleotide sequence for terminator tZmAG5-01 in vector 24289.

SEQ ID NO: 34 is a nucleotide sequence for vector 24299.

SEQ ID NO: 35 is the nucleotide sequence for promoter prZmAG5-01 in vector 24299.

SEQ ID NO: 36 is the nucleotide sequence for terminator tZmAG5-01 in vector 24299.

SEQ ID NO: 37 is a nucleotide sequence for vector 24230.

SEQ ID NO: 38 is the nucleotide sequence for promoter prZmAGO18B-01 in vector 24230.

SEQ ID NO: 39 is the nucleotide sequence for terminator tZmAGO18B-01 in vector 24230.

SEQ ID NO: 40 is a nucleotide sequence for vector 24243.

SEQ ID NO: 41 is the nucleotide sequence for promoter prOsMEL1-01 in vector 24243.

SEQ ID NO: 42 is the nucleotide sequence for terminator tOsMEL1-01 in vector 24243.

SEQ ID NO: 43 is a nucleotide sequence for vector 24305.

SEQ ID NO: 44 is the nucleotide sequence for promoter prOsMEL1-02 in vector 24305.

SEQ ID NO: 45 is the nucleotide sequence for terminator tOsMEL1-01 in vector 24305.

SEQ ID NO: 46 is a nucleotide sequence for vector 24306.

SEQ ID NO: 47 is the nucleotide sequence for promoter prZmCoLig-01 in vector 24306.

SEQ ID NO: 48 is the nucleotide sequence for terminator tZmCoLig-01 in vector 24306.

SEQ ID NO: 49 is a nucleotide sequence for vector 24320.

SEQ ID NO: 50 is the nucleotide sequence for promoter prZmBde1-02 in vector 24320.

SEQ ID NO: 51 is the nucleotide sequence for terminator tZmBde1-01 in vector 24320.

SEQ ID NO: 52 is a nucleotide sequence for vector 24426.

SEQ ID NO: 53 is the nucleotide sequence for promoter prOsZFP-01 in vector 24426.

SEQ ID NO: 54 is the nucleotide sequence for terminator tOsZFP-01 in vector 24426.

SEQ ID NO: 55 is a nucleotide sequence for vector 24427.

SEQ ID NO: 56 is the nucleotide sequence for promoter prZmAMS-01 in vector 24427.

SEQ ID NO: 57 is the nucleotide sequence for terminator tZmAMS-01 in vector 24427.

SEQ ID NO: 58 is a nucleotide sequence for vector 24428.

SEQ ID NO: 59 is the nucleotide sequence for promoter prZmAMS-01 in vector 24428.

SEQ ID NO: 60 is the nucleotide sequence for terminator tNOS-05-01 in vector 24428.

SEQ ID NO: 61 is a nucleotide sequence for vector 24454.

SEQ ID NO: 62 is the nucleotide sequence for promoter prZmExine1-01 in vector 24454.

SEQ ID NO: 63 is the nucleotide sequence for terminator tZmExine1-01 in vector 244254.

SEQ ID NO: 64 is a nucleotide sequence for vector 24455.

SEQ ID NO: 65 is the nucleotide sequence for promoter prOsExine1-01 in vector 24455.

SEQ ID NO: 66 is the nucleotide sequence for terminator tOsExine1-01 in vector 244255.

SEQ ID NO: 67 is a nucleotide sequence for vector 24458.

SEQ ID NO: 68 is the nucleotide sequence for promoter prZmAMS-01 in vector 24458.

SEQ ID NO: 69 is the nucleotide sequence for terminator tNOS-05-01 in vector 244258.

SEQ ID NO: 70 is a nucleotide sequence for vector 24459.

SEQ ID NO: 71 is the nucleotide sequence for promoter prOsTBr1-01 in vector 24459.

SEQ ID NO: 72 is the nucleotide sequence for terminator tOsTBr1-01 in vector 24429.

SEQ ID NO: 73 is a nucleotide sequence for vector 24460.

SEQ ID NO: 74 is the nucleotide sequence for promoter prOsAP1-01 in vector 24460.

SEQ ID NO: 75 is the nucleotide sequence for terminator tOsAP1-01 in vector 24460.

SEQ ID NO: 76 is a nucleotide sequence for vector 24548.

SEQ ID NO: 77 is the nucleotide sequence for promoter prZmRa2-02 in vector 24548.

SEQ ID NO: 78 is the nucleotide sequence for terminator tZmRa2-02 in vector 24548.

SEQ ID NO: 79 is a nucleotide sequence for vector 24602.

SEQ ID NO: 80 is the nucleotide sequence for promoter prOsCoLig-01 in vector 24602.

SEQ ID NO: 81 is the nucleotide sequence for terminator tOsCoLig-01 in vector 24602.

SEQ ID NO: 82 is a nucleotide sequence for vector 24688.

SEQ ID NO: 83 is the nucleotide sequence for promoter prZmWUS2-01 in vector 24688.

SEQ ID NO: 84 is the nucleotide sequence for terminator tZmWUS2-01 in vector 24688.

SEQ ID NO: 85 is a nucleotide sequence for vector 24300.

SEQ ID NO: 86 is the nucleotide sequence for promoter prZmAGO18B-01 in vector 24300.

SEQ ID NO: 87 is the nucleotide sequence for terminator tZmAGO18B-01 in vector 24300.

SEQ ID NO: 88 is a nucleotide sequence for vector 25123.

SEQ ID NO: 89 is the nucleotide sequence for promoter prZmBde1-02 in vector 25123.

SEQ ID NO: 90 is the nucleotide sequence for terminator tZmBde1-01 in vector 25123.

SEQ ID NO: 91 is the nucleotide sequence for promoter prOsU3-1 in vector 25123.

SEQ ID NO: 92 is the nucleotide sequence for intron iZmBde1-01 in vector 25123.

SEQ ID NO: 93 is the nucleotide sequence for xNLS-01 in vector 25123.

SEQ ID NO: 94 is the nucleotide sequence for xALS target-01 in vector 25123.

SEQ ID NO: 95 is the nucleotide sequence for ALS target in vector 25123.

SEQ ID NO: 96 is the nucleotide sequence for ALS target in vector 25123.

SEQ ID NO: 97 is the nucleotide sequence for xZmALS-V2 in vector 25123 (Donor DNA).

SEQ ID NO: 98 is the nucleotide sequence for rsgRNAZ-mALS-V1 in vector 25123.

SEQ ID NO: 99 is the nucleotide sequence for rCrRNA-01 in vector 25123.

SEQ ID NO: 100 is the nucleotide sequence for rTracrRNA-01 in vector 25123.

SEQ ID NO: 101 is the nucleotide sequence for promoter prOsU3-01 in vector 25123.

SEQ ID NO: 102 is the nucleotide sequence for Cas9 in 25123SEQ ID NO: 103 is an edited nucleotide sequence from a T1 progeny of vector, 24269, event number MZKE181002A135A, sample 1.

SEQ ID NO: 104 is an edited nucleotide sequence from a T1 progeny of vector, 24269, event number MZKE181002A135A, sample 1a.

SEQ ID NO: 105 is an edited nucleotide sequence from a T1 progeny of vector, 24269, event number MZKE181002A135A, sample 2.

SEQ ID NO: 106 is an edited nucleotide sequence from a T1 progeny of vector, 24269, event number MZKE181002A135A, sample 2a.

SEQ ID NO: 107 is an edited nucleotide sequence from a T1 progeny of vector, 24269, event number MZKE181002A135A, sample 3.

SEQ ID NO: 108 is an edited nucleotide sequence from a T1 progeny of vector, 24269, event number MZKE181002A135A, sample 4.

SEQ ID NO: 109 is an edited nucleotide sequence from a T1 progeny of vector, 24269, event number MZKE181002A135A, sample 5.

SEQ ID NO: 110 is an edited nucleotide sequence from a T1 progeny of vector, 24269, event number MZKE181002A135A, sample 6.

SEQ ID NO: 111 is an edited nucleotide sequence from a T1 progeny of vector, 24269, event number MZKE181002A135A, sample 6a.

SEQ ID NO: 112 is an edited nucleotide sequence from a T1 progeny of vector, 24269, event number MZKE181002A135A, sample 7.

SEQ ID NO: 113 is an edited nucleotide sequence from a T1 progeny of vector, 24269, event number MZKE181002A135A, sample 7a.

SEQ ID NO: 114 is an edited nucleotide sequence from a T1 progeny of vector, 24269, event number MZKE181002A135A, sample 8.

SEQ ID NO: 115 is an edited nucleotide sequence from a T1 progeny of vector, 24269, event number MZKE181002A135A, sample 9.

SEQ ID NO: 116 is an edited nucleotide sequence from a T1 progeny of vector, 24269, event number MZKE181002A135A, sample 10.

SEQ ID NO: 117 is an edited nucleotide sequence from a T1 progeny of vector, 24269, event number MZKE181002A135A, sample 10a.

SEQ ID NO: 118 is an edited nucleotide sequence from a T1 progeny of vector, 24269, event number MZKE181002A135A, sample 12.

SEQ ID NO: 119 is an edited nucleotide sequence from a T1 progeny of vector, 24269, event number MZKE181002A135A, sample 12a.

SEQ ID NO: 120 is an edited nucleotide sequence from a T1 progeny of vector, 24269, event number MZKE181002A135A, sample 14.

SEQ ID NO: 121 is an edited nucleotide sequence from a T1 progeny of vector, 24269, event number MZKE181002A135A, sample 14a.

SEQ ID NO: 122 is an edited nucleotide sequence from a T1 progeny of vector, 24269, event number MZKE181002A135A, sample 15.

SEQ ID NO: 123 is an edited nucleotide sequence from a T1 progeny of vector, 24269, event number MZKE181002A135A, sample 16.

SEQ ID NO: 124 is an edited nucleotide sequence from a T1 progeny of vector, 24269, event number MZKE181002A135A, sample 16a.

SEQ ID NO: 125 is an edited nucleotide sequence from a T1 progeny of vector, 24269, event number MZKE181002A135A, sample 17.

SEQ ID NO: 126 is an edited nucleotide sequence from a T1 progeny of vector, 24269, event number MZKE181002A135A, sample 17a.

SEQ ID NO: 127 is an edited nucleotide sequence from a T1 progeny of vector, 24269, event number MZKE181002A135A, sample 19.

SEQ ID NO: 128 is an edited nucleotide sequence from a T1 progeny of vector, 24269, event number MZKE181002A135A, sample 19a.

SEQ ID NO: 129 is an edited nucleotide sequence from a T1 progeny of vector, 24269, event number MZKE181002A135A, sample 19b.

SEQ ID NO: 130 is an edited nucleotide sequence from a T1 progeny of vector, 24269, event number MZKE181002A135A, sample 20.

SEQ ID NO: 131 is an edited nucleotide sequence from a T1 progeny of vector, 24269, event number MZKE181002A135A, sample 21.

SEQ ID NO: 132 is an edited nucleotide sequence from a T1 progeny of vector, 24269, event number MZKE181002A135A, sample 21a.

SEQ ID NO: 133 is an edited nucleotide sequence from a T1 progeny of vector, 24269, event number MZKE181002A135A, sample 22.

SEQ ID NO: 134 is an edited nucleotide sequence from a T1 progeny of vector, 24269, event number MZKE181002A135A, sample 22a.

SEQ ID NO: 135 is an edited nucleotide sequence from a T1 progeny of vector, 24269, event number MZKE181002A135A, sample 23.

SEQ ID NO: 136 is an edited nucleotide sequence from a T1 progeny of vector, 24269, event number MZKE181002A135A, sample 23a.

SEQ ID NO: 137 is an edited nucleotide sequence from a T1 progeny of vector, 24269, event number MZKE181002A135A, sample 23b.

SEQ ID NO: 138 is an edited nucleotide sequence from a T1 progeny of vector, 24269, event number MZKE181002A135A, sample 24.

SEQ ID NO: 139 is an edited nucleotide sequence from a T1 progeny of vector, 24269, event number MZKE181002A135A, sample 24a.

SEQ ID NO: 140 is an edited nucleotide sequence from a T1 progeny of vector, 24269, event number MZKE181002A135A, sample 24b.

SEQ ID NO: 141 is an edited nucleotide sequence from a T1 progeny of vector, 24269, event number MZKE181002A135A, sample 25.

SEQ ID NO: 142 is an edited nucleotide sequence from a T1 progeny of vector, 24269, event number MZKE181002A135A, sample 25a.

SEQ ID NO: 143 is an edited nucleotide sequence from a T1 progeny of vector, 24269, event number MZKE181002A135A, sample 26.

SEQ ID NO: 144 is an edited nucleotide sequence from a T1 progeny of vector, 24269, event number MZKE181002A135A, sample 26.

SEQ ID NO: 145 is an edited nucleotide sequence from a T1 progeny of vector, 24269, event number MZKE181002A135A, sample 27.

SEQ ID NO: 146 is an edited nucleotide sequence from a T1 progeny of vector, 24269, event number MZKE181002A135A, sample 28.

SEQ ID NO: 147 is an edited nucleotide sequence from a T1 progeny of vector, 24269, event number MZKE181002A135A, sample 28a.

SEQ ID NO: 148 is an edited nucleotide sequence from a T1 progeny of vector, 24269, event number MZKE181002A135A, sample 29.

SEQ ID NO: 149 is an edited nucleotide sequence from a T1 progeny of vector, 24269, event number MZKE181002A135A, sample 29a.

SEQ ID NO: 150 is an edited nucleotide sequence from a T1 progeny of vector, 24269, event number MZKE181002A135A, sample 30.

SEQ ID NO: 151 is an edited nucleotide sequence from a T1 progeny of vector, 24269, event number MZKE181002A135A, sample 30a.

SEQ ID NO: 152 is an edited nucleotide sequence from a T1 progeny of vector, 24269, event number MZKE181002A135A, sample 31.

SEQ ID NO: 153 is an edited nucleotide sequence from a T1 progeny of vector, 24269, event number MZKE181002A135A, sample 32.

SEQ ID NO: 154 is an edited nucleotide sequence from a T1 progeny of vector, 24269, event number MZKE181002A135A, sample 32a.

SEQ ID NO: 155 is an edited nucleotide sequence from a T1 progeny of vector, 24269, event number MZKE181002A135A, sample 33.

SEQ ID NO: 156 is an edited nucleotide sequence from a T1 progeny of vector, 24269, event number MZKE181002A135A, sample 33a.

SEQ ID NO: 157 is an edited nucleotide sequence from a T1 progeny of vector, 24269, event number MZKE181002A135A, sample 34.

SEQ ID NO: 158 is an edited nucleotide sequence from a T1 progeny of vector, 24269, event number MZKE181002A135A, sample 34a.

SEQ ID NO: 159 is an edited nucleotide sequence from a T1 progeny of vector, 24269, event number MZKE181002A135A, sample 35.

SEQ ID NO: 160 is an edited nucleotide sequence from a T1 progeny of vector, 24269, event number MZKE181002A135A, sample 35a.

SEQ ID NO: 161 is an edited nucleotide sequence from a T1 progeny of vector, 24269, event number MZKE181002A135A, sample 36.

SEQ ID NO: 162 is an edited nucleotide sequence from a T1 progeny of vector, 24269, event number MZKE181002A135A, sample 36a.

SEQ ID NO: 163 is an edited nucleotide sequence from a T1 progeny of vector, 24269, event number MZKE181002A135A, sample 37.

SEQ ID NO: 164 is an edited nucleotide sequence from a T1 progeny of vector, 24269, event number MZKE181002A135A, sample 37a.

SEQ ID NO: 165 is an edited nucleotide sequence from a T1 progeny of vector, 24269, event number MZKE181002A135A, sample 38.

SEQ ID NO: 166 is an edited nucleotide sequence from a T1 progeny of vector, 24269, event number MZKE181002A135A, sample 38a.

SEQ ID NO: 167 is an edited nucleotide sequence from a T1 progeny of vector, 24269, event number MZKE181002A135A, sample 39.

SEQ ID NO: 168 is an edited nucleotide sequence from a T1 progeny of vector, 24269, event number MZKE181002A135A, sample 39a.

SEQ ID NO: 169 is an edited nucleotide sequence from a T1 progeny of vector, 24269, event number MZKE181002A135A, sample 40.

SEQ ID NO: 170 is an edited nucleotide sequence from a T1 progeny of vector, 24269, event number MZKE181002A135A, sample 40a.

SEQ ID NO: 171 is an edited nucleotide sequence from a T1 progeny of vector, 24269, event number MZKE181002A135A, sample 41.

SEQ ID NO: 172 is an edited nucleotide sequence from a T1 progeny of vector, 24269, event number MZKE181002A135A, sample 42.

SEQ ID NO: 173 is an edited nucleotide sequence from a T1 progeny of vector, 24269, event number MZKE181002A135A, sample 42a.

SEQ ID NO: 174 is an edited nucleotide sequence from a T1 progeny of vector, 24269, event number MZKE181002A135A, sample 43.

SEQ ID NO: 175 is an edited nucleotide sequence from a T1 progeny of vector, 24269, event number MZKE181002A135A, sample 44.

SEQ ID NO: 176 is an edited nucleotide sequence from a T1 progeny of vector, 24269, event number MZKE181002A135A, sample 44a.

SEQ ID NO: 177 is an edited nucleotide sequence from a T1 progeny of vector, 24269, event number MZKE181002A135A, sample 45.

SEQ ID NO: 178 is an edited nucleotide sequence from a T1 progeny of vector, 24269, event number MZKE181002A135A, sample 45a.

SEQ ID NO: 179 is an edited nucleotide sequence from a T1 progeny of vector, 24269, event number MZKE181002A135A, sample 46.

SEQ ID NO: 180 is an edited nucleotide sequence from a T1 progeny of vector, 24269, event number MZKE181002A135A, sample 47.

SEQ ID NO: 181 is an edited nucleotide sequence from a T1 progeny of vector, 24269, event number MZKE181002A135A, sample 47a.

SEQ ID NO: 182 is an edited nucleotide sequence from a T1 progeny of vector, 24269, event number MZKE181002A135A, sample 48.

SEQ ID NO: 183 is an edited nucleotide sequence from a T1 progeny of vector, 24269, event number MZKE181002A135A, sample 49.

SEQ ID NO: 184 is an edited nucleotide sequence from a T1 progeny of vector, 24269, event number MZKE181002A135A, sample 49a.

SEQ ID NO: 185 is an edited nucleotide sequence from a T1 progeny of vector, 24269, event number MZKE181002A135A, sample 50.

SEQ ID NO: 186 is the nucleotide sequence for vector AR-SDN2_REP_NoCut.

SEQ ID NO: 187 is the nucleotide sequence for vector AR-SDN2_REP_2 Cuts.

SEQ ID NO: 188 is the nucleotide sequence for vector AR-SDN2_REP_1 Cut.

SEQ ID NO: 189 is an edited nucleotide sequence from a T1 progeny of vector, 24269, event number MZKE181002A135A, sample 13.

SEQ ID NO: 190 is an edited nucleotide sequence from a T1 progeny of vector 24301, event number MZKE18100A050A, sample 1a.

SEQ ID NO: 191 is an edited nucleotide sequence from a T1 progeny of vector 24301, event number MZKE18100A050A, sample 1b.

SEQ ID NO: 192 is an edited nucleotide sequence from a T1 progeny of vector 24301, event number MZKE18100A050A, sample 2a.

SEQ ID NO: 193 is an edited nucleotide sequence from a T1 progeny of vector 24301, event number MZKE18100A050A, sample 2b.

SEQ ID NO: 194 is an edited nucleotide sequence from a T1 progeny of vector 24301, event number MZKE18100A050A, sample 3.

SEQ ID NO: 195 is an edited nucleotide sequence from a T1 progeny of vector 24301, event number MZKE18100A050A, sample 4a.

SEQ ID NO: 196 is an edited nucleotide sequence from a T1 progeny of vector 24301, event number MZKE18100A050A, sample 4b.

SEQ ID NO: 197 is an edited nucleotide sequence from a T1 progeny of vector 24301, event number MZKE18100A050A, sample 5a.

SEQ ID NO: 198 is an edited nucleotide sequence from a T1 progeny of vector 24301, event number MZKE18100A050A, sample 5b.

SEQ ID NO: 199 is an edited nucleotide sequence from a T1 progeny of vector 24301, event number MZKE18100A050A, sample 6.

SEQ ID NO: 200 is an edited nucleotide sequence from a T1 progeny of vector 24301, event number MZKE18100A050A, sample 7a.

SEQ ID NO: 201 is an edited nucleotide sequence from a T1 progeny of vector 24301, event number MZKE18100A050A, sample 7b.

SEQ ID NO: 202 is an edited nucleotide sequence from a T1 progeny of vector 24301, event number MZKE18100A050A, sample 8a.

SEQ ID NO: 203 is an edited nucleotide sequence from a T1 progeny of vector 24301, event number MZKE18100A050A, sample 8b.

SEQ ID NO: 204 is an edited nucleotide sequence from a T1 progeny of vector 24301, event number MZKE18100A050A, sample 9a.

SEQ ID NO: 205 is an edited nucleotide sequence from a T1 progeny of vector 24301, event number MZKE18100A050A, sample 9b.

SEQ ID NO: 206 is an edited nucleotide sequence from a T1 progeny of vector 24301, event number MZKE18100A050A, sample 10.

SEQ ID NO: 207 is an edited nucleotide sequence from a T1 progeny of vector 24301, event number MZKE18100A050A, sample 11a.

SEQ ID NO: 208 is an edited nucleotide sequence from a T1 progeny of vector 24301, event number MZKE18100A050A, sample 11b.

SEQ ID NO: 209 is an edited nucleotide sequence from a T1 progeny of vector 24301, event number MZKE18100A050A, sample 12.

SEQ ID NO: 210 is an edited nucleotide sequence from a T1 progeny of vector 24301, event number MZKE18100A050A, sample 13a.

SEQ ID NO: 211 is an edited nucleotide sequence from a T1 progeny of vector 24301, event number MZKE18100A050A, sample 13b.

SEQ ID NO: 212 is an edited nucleotide sequence from a T1 progeny of vector 24301, event number MZKE18100A050A, sample 14.

SEQ ID NO: 213 is an edited nucleotide sequence from a T1 progeny of vector 24301, event number MZKE18100A050A, sample 15.

SEQ ID NO: 214 is an edited nucleotide sequence from a T1 progeny of vector 24301, event number MZKE18100A050A, sample 16a.

SEQ ID NO: 215 is an edited nucleotide sequence from a T1 progeny of vector 24301, event number MZKE18100A050A, sample 16b.

SEQ ID NO: 216 is an edited nucleotide sequence from a T1 progeny of vector 24301, event number MZKE18100A050A, sample 17a.

SEQ ID NO: 217 is an edited nucleotide sequence from a T1 progeny of vector 24301, event number MZKE18100A050A, sample 17b.

SEQ ID NO: 218 is an edited nucleotide sequence from a T1 progeny of vector 24301, event number MZKE18100A050A, sample 18a.

SEQ ID NO: 219 is an edited nucleotide sequence from a T1 progeny of vector 24301, event number MZKE18100A050A, sample 18b.

SEQ ID NO: 220 is an edited nucleotide sequence from a T1 progeny of vector 24301, event number MZKE18100A050A, sample 19.

SEQ ID NO: 221 is an edited nucleotide sequence from a T1 progeny of vector 24301, event number MZKE18100A050A, sample 20a.

SEQ ID NO: 222 is an edited nucleotide sequence from a T1 progeny of vector 24301, event number MZKE18100A050A, sample 20b.

SEQ ID NO: 223 is an edited nucleotide sequence from a T1 progeny of vector 24301, event number MZKE18100A050A, sample 21.

SEQ ID NO: 224 is an edited nucleotide sequence from a T1 progeny of vector 24301, event number MZKE18100A063A, sample 1a.

SEQ ID NO: 225 is an edited nucleotide sequence from a T1 progeny of vector 24301, event number MZKE18100A063A, sample 1b.

SEQ ID NO: 226 is an edited nucleotide sequence from a T1 progeny of vector 24301, event number MZKE18100A063A, sample 2a.

SEQ ID NO: 227 is an edited nucleotide sequence from a T1 progeny of vector 24301, event number MZKE18100A063A, sample 2b.

SEQ ID NO: 228 is an edited nucleotide sequence from a T1 progeny of vector 24301, event number MZKE18100A063A, sample 3.

SEQ ID NO: 229 is an edited nucleotide sequence from a T1 progeny of vector 24301, event number MZKE18100A063A, sample 4a.

SEQ ID NO: 230 is an edited nucleotide sequence from a T1 progeny of vector 24301, event number MZKE18100A063A, sample 4b.

SEQ ID NO: 231 is an edited nucleotide sequence from a T1 progeny of vector 24301, event number MZKE18100A063A, sample 5a.

SEQ ID NO: 232 is an edited nucleotide sequence from a T1 progeny of vector 24301, event number MZKE18100A063A, sample 5b.

SEQ ID NO: 233 is an edited nucleotide sequence from a T1 progeny of vector 24301, event number MZKE18100A063A, sample 6a.

SEQ ID NO: 234 is an edited nucleotide sequence from a T1 progeny of vector 24301, event number MZKE18100A063A, sample 6b.

SEQ ID NO: 235 is an edited nucleotide sequence from a T1 progeny of vector 24301, event number MZKE18100A063A, sample 7a.

SEQ ID NO: 236 is an edited nucleotide sequence from a T1 progeny of vector 24301, event number MZKE18100A063A, sample 7b.

SEQ ID NO: 237 is an edited nucleotide sequence from a T1 progeny of vector 24301, event number MZKE18100A063A, sample 8a.

SEQ ID NO: 238 is an edited nucleotide sequence from a T1 progeny of vector 24301, event number MZKE18100A063A, sample 8b.

SEQ ID NO: 239 is an edited nucleotide sequence from a T1 progeny of vector 24301, event number MZKE18100A064A, sample 1.

SEQ ID NO: 240 is an edited nucleotide sequence from a T1 progeny of vector 24301, event number MZKE18100A064A, sample 2a.

SEQ ID NO: 241 is an edited nucleotide sequence from a T1 progeny of vector 24301, event number MZKE18100A064A, sample 2b.

SEQ ID NO: 242 is an edited nucleotide sequence from a T1 progeny of vector 24301, event number MZKE18100A064A, sample 3a.

SEQ ID NO: 243 is an edited nucleotide sequence from a T1 progeny of vector 24301, event number MZKE18100A064A, sample 3b.

SEQ ID NO: 244 is an edited nucleotide sequence from a T1 progeny of vector 24301, event number MZKE18100A064A, sample 4a.

SEQ ID NO: 245 is an edited nucleotide sequence from a T1 progeny of vector 24301, event number MZKE18100A064A, sample 4b.

SEQ ID NO: 246 is an edited nucleotide sequence from a T1 progeny of vector 24301, event number MZKE18100A064A, sample 5a.

SEQ ID NO: 247 is an edited nucleotide sequence from a T1 progeny of vector 24301, event number MZKE18100A064A, sample 5b.

SEQ ID NO: 248 is an edited nucleotide sequence from a T1 progeny of vector 24301, event number MZKE18100A064A, sample 6a.

SEQ ID NO: 249 is an edited nucleotide sequence from a T1 progeny of vector 24301, event number MZKE18100A064A, sample 6b.

SEQ ID NO: 250 is an edited nucleotide sequence from a T1 progeny of vector 24301, event number MZKE18100A064A, sample 7a.

SEQ ID NO: 251 is an edited nucleotide sequence from a T1 progeny of vector 24301, event number MZKE18100A064A, sample 7b.

SEQ ID NO: 252 is an edited nucleotide sequence from a T1 progeny of vector 24301, event number MZKE18100A064A, sample 8a.

SEQ ID NO: 253 is an edited nucleotide sequence from a T1 progeny of vector 24301, event number MZKE18100A064A, sample 8b.

SEQ ID NO: 254 is an edited nucleotide sequence from a T1 progeny of vector 24301, event number MZKE18100A064A, sample 9a.

SEQ ID NO: 255 is an edited nucleotide sequence from a T1 progeny of vector 24301, event number MZKE18100A064A, sample 9b.

SEQ ID NO: 256 is an edited nucleotide sequence from a T1 progeny of vector 24301, event number MZKE18100A064A, sample 10a.

SEQ ID NO: 257 is an edited nucleotide sequence from a T1 progeny of vector 24301, event number MZKE18100A064A, sample 10b.

SEQ ID NO: 258 is an edited nucleotide sequence from a T1 progeny of vector 24301, event number MZKE18100A064A, sample 11a.

SEQ ID NO: 259 is an edited nucleotide sequence from a T1 progeny of vector 24301, event number MZKE18100A064A, sample 11b.

SEQ ID NO: 260 is an edited nucleotide sequence from a T1 progeny of vector 24301, event number MZKE18100A078A, sample 1a.

SEQ ID NO: 261 is an edited nucleotide sequence from a T1 progeny of vector 24301, event number MZKE18100A078A, sample 1b.

SEQ ID NO: 262 is an edited nucleotide sequence from a T1 progeny of vector 24301, event number MZKE18100A078A, sample 2a.

SEQ ID NO: 263 is an edited nucleotide sequence from a T1 progeny of vector 24301, event number MZKE18100A078A, sample 2b.

SEQ ID NO: 264 is an edited nucleotide sequence from a T1 progeny of vector 24301, event number MZKE18100A078A, sample 3a.

SEQ ID NO: 265 is an edited nucleotide sequence from a T1 progeny of vector 24301, event number MZKE18100A078A, sample 3b.

SEQ ID NO: 266 is an edited nucleotide sequence from a T1 progeny of vector 24301, event number MZKE18100A078A, sample 4a.

SEQ ID NO: 267 is an edited nucleotide sequence from a T1 progeny of vector 24301, event number MZKE18100A078A, sample 4b.

SEQ ID NO: 268 is an edited nucleotide sequence from a T1 progeny of vector 24301, event number MZKE18100A078A, sample 5a.

SEQ ID NO: 269 is an edited nucleotide sequence from a T1 progeny of vector 24301, event number MZKE18100A078A, sample 5b.

SEQ ID NO: 270 is an edited nucleotide sequence from a T1 progeny of vector 24301, event number MZKE18100A078A, sample 6a.

SEQ ID NO: 271 is an edited nucleotide sequence from a T1 progeny of vector 24301, event number MZKE18100A078A, sample 6b.

SEQ ID NO: 272 is an edited nucleotide sequence from a T1 progeny of vector 24301, event number MZKE18100A078A, sample 7a.

SEQ ID NO: 273 is an edited nucleotide sequence from a T1 progeny of vector 24301, event number MZKE18100A078A, sample 7b.

SEQ ID NO: 274 is an edited nucleotide sequence from a T1 progeny of vector 24301, event number MZKE18100A078A, sample 8a.

SEQ ID NO: 275 is an edited nucleotide sequence from a T1 progeny of vector 24301, event number MZKE18100A078A, sample 8b.

SEQ ID NO: 276 is an edited nucleotide sequence from a T1 progeny of vector 24301, event number MZKE18100A078A, sample 9a.

SEQ ID NO: 277 is an edited nucleotide sequence from a T1 progeny of vector 24301, event number MZKE18100A078A, sample 9b.

SEQ ID NO: 278 is an edited nucleotide sequence from a T1 progeny of vector 24301, event number MZKE18100A078A, sample 10a.

SEQ ID NO: 279 is an edited nucleotide sequence from a T1 progeny of vector 24301, event number MZKE18100A078A, sample 10b.

SEQ ID NO: 280 is an edited nucleotide sequence from a T1 progeny of vector 24301, event number MZKE18100A078A, sample 11.

SEQ ID NO: 281 is an edited nucleotide sequence from a T1 progeny of vector 24301, event number MZKE18100A078A, sample 12a.

SEQ ID NO: 282 is an edited nucleotide sequence from a T1 progeny of vector 24301, event number MZKE18100A078A, sample 12b.

SEQ ID NO: 283 is an edited nucleotide sequence from a T1 progeny of vector 24301, event number MZKE18100A078A, sample 13.

SEQ ID NO: 284 is an edited nucleotide sequence from a T1 progeny of vector 24301, event number MZKE18100A078A, sample 14a.

SEQ ID NO: 285 is an edited nucleotide sequence from a T1 progeny of vector 24301, event number MZKE18100A078A, sample 14b.

SEQ ID NO: 286 is an edited nucleotide sequence from a T1 progeny of vector 24301, event number MZKE18100A078A, sample 15a.

SEQ ID NO: 287 is an edited nucleotide sequence from a T1 progeny of vector 24301, event number MZKE18100A078A, sample 15b.

SEQ ID NO: 288 is an edited nucleotide sequence from a T1 progeny of vector 24301, event number MZKE18100A078A, sample 16a.

SEQ ID NO: 289 is an edited nucleotide sequence from a T1 progeny of vector 24301, event number MZKE18100A078A, sample 16b.

SEQ ID NO: 290 is an edited nucleotide sequence from a T1 progeny of vector 24301, event number MZKE18100A078A, sample 17a.

SEQ ID NO: 291 is an edited nucleotide sequence from a T1 progeny of vector 24301, event number MZKE18100A078A, sample 17b.

SEQ ID NO: 292 is an edited nucleotide sequence from a T1 progeny of vector 24301, event number MZKE18100A078A, sample 18a.

SEQ ID NO: 293 is an edited nucleotide sequence from a T1 progeny of vector 24301, event number MZKE18100A078A, sample 18b.

SEQ ID NO: 294 is an edited nucleotide sequence from a T1 progeny of vector 24301, event number MZKE18100A078A, sample 19a.

SEQ ID NO: 295 is an edited nucleotide sequence from a T1 progeny of vector 24301, event number MZKE18100A078A, sample 19b.

SEQ ID NO: 296 is an edited nucleotide sequence from a T1 progeny of vector 24301, event number MZKE18100A078A, sample 20a.

SEQ ID NO: 297 is an edited nucleotide sequence from a T1 progeny of vector 24301, event number MZKE18100A078A, sample 20b.

SEQ ID NO: 298 is an edited nucleotide sequence from a T1 progeny of vector 24301, event number MZKE18100A078A, sample 21a.

SEQ ID NO: 299 is an edited nucleotide sequence from a T1 progeny of vector 24301, event number MZKE18100A078A, sample 21b.

SEQ ID NO: 300 is an edited nucleotide sequence from a T1 progeny of vector 24301, event number MZKE18100A078A, sample 22.

SEQ ID NO: 301 is an edited nucleotide sequence from a T1 progeny of vector 24301, event number MZKE18100A078A, sample 23a.

SEQ ID NO: 302 is an edited nucleotide sequence from a T1 progeny of vector 24301, event number MZKE18100A078A sample 23b.

SEQ ID NO: 303 is an edited nucleotide sequence from a T1 progeny of vector 24301, event number MZKE18100A078A, sample 24.

SEQ ID NO: 304 is an edited nucleotide sequence from a T1 progeny of vector 24301, event number MZKE18100A078A, sample 25a.

SEQ ID NO: 305 is an edited nucleotide sequence from a T1 progeny of vector 24301, event number MZKE18100A078A, sample 25b.

SEQ ID NO: 306 is an edited nucleotide sequence from a T1 progeny of vector 24301, event number MZKE18100A078A, sample 26.

SEQ ID NO: 307 is an edited nucleotide sequence from a T1 progeny of vector 24301, event number MZKE18100A078A, sample 26b.

SEQ ID NO: 308 is an edited nucleotide sequence from a T1 progeny of vector 24301, event number MZKE18100A078A, sample 27a.

SEQ ID NO: 309 is an edited nucleotide sequence from a T1 progeny of vector 24301, event number MZKE18100A078A, sample 27b.

SEQ ID NO: 310 is an edited nucleotide sequence from a T1 progeny of vector 24301, event number MZKE18100A078A, sample 28a.

SEQ ID NO: 311 is an edited nucleotide sequence from a T1 progeny of vector 24301, event number MZKE18100A078A, sample 28b.

SEQ ID NO: 312 is an edited nucleotide sequence from a T1 progeny of vector 24301, event number MZKE18100A078A, sample 29a.

SEQ ID NO: 313 is an edited nucleotide sequence from a T1 progeny of vector 24301, event number MZKE18100A078A, sample 29b.

SEQ ID NO: 314 is an edited nucleotide sequence from a T1 progeny of vector 24301, event number MZKE18100A084A, sample 1.

SEQ ID NO: 315 is an edited nucleotide sequence from a T1 progeny of vector 24301, event number MZKE18100A084A, sample 2a.

SEQ ID NO: 316 is an edited nucleotide sequence from a T1 progeny of vector 24301, event number MZKE18100A084A, sample 2b.

SEQ ID NO: 317 is an edited nucleotide sequence from a T1 progeny of vector 24301, event number MZKE18100A084A, sample 3a.

SEQ ID NO: 318 is an edited nucleotide sequence from a T1 progeny of vector 24301, event number MZKE18100A084A, sample 3b.

SEQ ID NO: 319 is an edited nucleotide sequence from a T1 progeny of vector 24301, event number MZKE18100A084A, sample 4.

SEQ ID NO: 320 is an edited nucleotide sequence from a T1 progeny of vector 24301, event number MZKE18100A084A, sample 5a.

SEQ ID NO: 321 is an edited nucleotide sequence from a T1 progeny of vector 24301, event number MZKE18100A084A, sample 5b.

SEQ ID NO: 322 is an edited nucleotide sequence from a T1 progeny of vector 24301, event number MZKE18100A084A, sample 6a.

SEQ ID NO: 323 is an edited nucleotide sequence from a T1 progeny of vector 24301, event number MZKE18100A084A, sample 6b.

SEQ ID NO: 324 is an edited nucleotide sequence from a T1 progeny of vector 24301, event number MZKE18100A084A, sample 7a.

SEQ ID NO: 325 is an edited nucleotide sequence from a T1 progeny of vector 24301, event number MZKE18100A084A, sample 7b.

SEQ ID NO: 326 is an edited nucleotide sequence from a T1 progeny of vector 24301, event number MZKE18100A084A, sample 8a.

SEQ ID NO: 327 is an edited nucleotide sequence from a T1 progeny of vector 24301, event number MZKE18100A084A, sample 8b.

SEQ ID NO: 328 is an edited nucleotide sequence from a T1 progeny of vector 24301, event number MZKE18100A084A, sample 9a.

SEQ ID NO: 329 is an edited nucleotide sequence from a T1 progeny of vector 24301, event number MZKE18100A084A, sample 9b.

SEQ ID NO: 330 is an edited nucleotide sequence from a T1 progeny of vector 24301, event number MZKE18100A084A, sample 10a.

SEQ ID NO: 331 is an edited nucleotide sequence from a T1 progeny of vector 24301, event number MZKE18100A084A, sample 10b.

SEQ ID NO: 332 is an edited nucleotide sequence from a T1 progeny of vector 24301, event number MZKE18100A084A, sample 11a.

SEQ ID NO: 333 is an edited nucleotide sequence from a T1 progeny of vector 24301, event number MZKE18100A084A, sample 11b.

SEQ ID NO: 334 is an edited nucleotide sequence from a T1 progeny of vector 24301, event number MZKE18100A084A, sample 12a.

SEQ ID NO: 335 is an edited nucleotide sequence from a T1 progeny of vector 24301, event number MZKE18100A084A, sample 12b.

SEQ ID NO: 336 is an edited nucleotide sequence from a T1 progeny of vector 24301, event number MZKE18100A084A, sample 13a.

SEQ ID NO: 337 is an edited nucleotide sequence from a T1 progeny of vector 24301, event number MZKE18100A084A, sample 13b.

SEQ ID NO: 338 is an edited nucleotide sequence from a T1 progeny of vector 24301, event number MZKE18100A084A, sample 14a.

SEQ ID NO: 339 is an edited nucleotide sequence from a T1 progeny of vector 24301, event number MZKE18100A084A, sample 14b.

SEQ ID NO: 340 is an edited nucleotide sequence from a T1 progeny of vector 24301, event number MZKE18100A084A, sample 15a.

SEQ ID NO: 341 is an edited nucleotide sequence from a T1 progeny of vector 24301, event number MZKE18100A084A, sample 15b.

SEQ ID NO: 342 is an edited nucleotide sequence from a T1 progeny of vector 24301, event number MZKE18100A084A, sample 16a.

SEQ ID NO: 343 is an edited nucleotide sequence from a T1 progeny of vector 24301, event number MZKE18100A084A, sample 16b.

SEQ ID NO: 344 is an edited nucleotide sequence from a T1 progeny of vector 24301, event number MZKE18100A084A, sample 17a.

SEQ ID NO: 345 is an edited nucleotide sequence from a T1 progeny of vector 24301, event number MZKE18100A084A, sample 17b.

SEQ ID NO: 346 is an edited nucleotide sequence from a T1 progeny of vector 24301, event number MZKE18100A084A, sample 18.

SEQ ID NO: 347 is an edited nucleotide sequence from a T1 progeny of vector 24301, event number MZKE18100A084A, sample 19a.

SEQ ID NO: 348 is an edited nucleotide sequence from a T1 progeny of vector 24301, event number MZKE18100A084A, sample 19b.

SEQ ID NO: 349 is an edited nucleotide sequence from a T1 progeny of vector 24320, event number MZKE18200A019A, sample 1a.

SEQ ID NO: 350 is an edited nucleotide sequence from a T1 progeny of vector 24320, event number MZKE18200A019A, sample 1b.

SEQ ID NO: 351 is an edited nucleotide sequence from a T1 progeny of vector 24320, event number MZKE18200A019A, sample 2a.

SEQ ID NO: 352 is an edited nucleotide sequence from a T1 progeny of vector 24320, event number MZKE18200A019A, sample 2b.

SEQ ID NO: 353 is an edited nucleotide sequence from a T1 progeny of vector 24320, event number MZKE18200A019A, sample 3a.

SEQ ID NO: 354 is an edited nucleotide sequence from a T1 progeny of vector 24320, event number MZKE18200A019A, sample 3b.

SEQ ID NO: 355 is an edited nucleotide sequence from a T1 progeny of vector 24320, event number MZKE18200A019A, sample 4a.

SEQ ID NO: 356 is an edited nucleotide sequence from a T1 progeny of vector 24320, event number MZKE18200A019A, sample 4b.

SEQ ID NO: 357 is an edited nucleotide sequence from a T1 progeny of vector 24320, event number MZKE18200A019A, sample 5a.

SEQ ID NO: 358 is an edited nucleotide sequence from a T1 progeny of vector 24320, event number MZKE18200A019A, sample 5b.

SEQ ID NO: 359 is an edited nucleotide sequence from a T1 progeny of vector 24320, event number MZKE18200A019A, sample 6a.

SEQ ID NO: 360 is an edited nucleotide sequence from a T1 progeny of vector 24320, event number MZKE18200A019A, sample 6b.

SEQ ID NO: 361 is an edited nucleotide sequence from a T1 progeny of vector 24320, event number MZKE18200A019A, sample 7a.

SEQ ID NO: 362 is an edited nucleotide sequence from a T1 progeny of vector 24320, event number MZKE18200A019A, sample 7b.

SEQ ID NO: 363 is an edited nucleotide sequence from a T1 progeny of vector 24320, event number MZKE18200A019A, sample 8.

SEQ ID NO: 364 is an edited nucleotide sequence from a T1 progeny of vector 24320, event number MZKE18200A019A, sample 9a.

SEQ ID NO: 365 is an edited nucleotide sequence from a T1 progeny of vector 24320, event number MZKE18200A019A, sample 9b.

SEQ ID NO: 366 is an edited nucleotide sequence from a T1 progeny of vector 24320, event number MZKE18200A019A, sample 10.

SEQ ID NO: 367 is an edited nucleotide sequence from a T1 progeny of vector 24320, event number MZKE18200A019A, sample 11.

SEQ ID NO: 368 is an edited nucleotide sequence from a T1 progeny of vector 24320, event number MZKE18200A019A, sample 12a.

SEQ ID NO: 369 is an edited nucleotide sequence from a T1 progeny of vector 24320, event number MZKE18200A019A, sample 12b.

SEQ ID NO: 370 is an edited nucleotide sequence from a T1 progeny of vector 24320, event number MZKE18200A019A, sample 13a.

SEQ ID NO: 371 is an edited nucleotide sequence from a T1 progeny of vector 24320, event number MZKE18200A019A, sample 13b.

SEQ ID NO: 372 is an edited nucleotide sequence from a T1 progeny of vector 24320, event number MZKE18200A019A, sample 14.

SEQ ID NO: 373 is an edited nucleotide sequence from a T1 progeny of vector 24320, event number MZKE18200A019A, sample 15a.

SEQ ID NO: 374 is an edited nucleotide sequence from a T1 progeny of vector 24320, event number MZKE18200A019A, sample 15b.

SEQ ID NO: 375 is an edited nucleotide sequence from a T1 progeny of vector 24320, event number MZKE18200A019A, sample 16a.

SEQ ID NO: 376 is an edited nucleotide sequence from a T1 progeny of vector 24320, event number MZKE18200A019A, sample 16b.

SEQ ID NO: 377 is an edited nucleotide sequence from a T1 progeny of vector 24320, event number MZKE18200A019A, sample 17.

SEQ ID NO: 378 is an edited nucleotide sequence from a T1 progeny of vector 24320, event number MZKE18200A028A, sample 1a.

SEQ ID NO: 379 is an edited nucleotide sequence from a T1 progeny of vector 24320, event number MZKE18200A028A, sample 1b.

SEQ ID NO: 380 is an edited nucleotide sequence from a T1 progeny of vector 24320, event number MZKE18200A028A, sample 2a.

SEQ ID NO: 381 is an edited nucleotide sequence from a T1 progeny of vector 24320, event number MZKE18200A028A, sample 2b.

SEQ ID NO: 382 is an edited nucleotide sequence from a T1 progeny of vector 24320, event number MZKE18200A028A, sample 3a.

SEQ ID NO: 383 is an edited nucleotide sequence from a T1 progeny of vector 24320, event number MZKE18200A028A, sample 3b.

SEQ ID NO: 384 is an edited nucleotide sequence from a T1 progeny of vector 24320, event number MZKE18200A028A, sample 4a.

SEQ ID NO: 385 is an edited nucleotide sequence from a T1 progeny of vector 24320, event number MZKE18200A028A, sample 4b.

SEQ ID NO: 386 is an edited nucleotide sequence from a T1 progeny of vector 24320, event number MZKE18200A028A, sample 5.

SEQ ID NO: 387 is an edited nucleotide sequence from a T1 progeny of vector 24320, event number MZKE18200A028A, sample 6a.

SEQ ID NO: 388 is an edited nucleotide sequence from a T1 progeny of vector 24320, event number MZKE18200A028A, sample 6b.

SEQ ID NO: 389 is an edited nucleotide sequence from a T1 progeny of vector 24320, event number MZKE18200A028A, sample 7a.

SEQ ID NO: 390 is an edited nucleotide sequence from a T1 progeny of vector 24320, event number MZKE18200A028A, sample 7b.

SEQ ID NO: 391 is an edited nucleotide sequence from a T1 progeny of vector 24320, event number MZKE18200A028A, sample 8a.

SEQ ID NO: 392 is an edited nucleotide sequence from a T1 progeny of vector 24320, event number MZKE18200A028A, sample 8b.

SEQ ID NO: 393 is an edited nucleotide sequence from a T1 progeny of vector 24320, event number MZKE18200A028A, sample 9a.

SEQ ID NO: 394 is an edited nucleotide sequence from a T1 progeny of vector 24320, event number MZKE18200A028A, sample 9b.

SEQ ID NO: 395 is an edited nucleotide sequence from a T1 progeny of vector 24320, event number MZKE18200A028A, sample 10.

SEQ ID NO: 396 is an edited nucleotide sequence from a T1 progeny of vector 24320, event number MZKE18200A028A, sample 11a.

SEQ ID NO: 397 is an edited nucleotide sequence from a T1 progeny of vector 24320, event number MZKE18200A028A, sample 11b.

SEQ ID NO: 398 is an edited nucleotide sequence from a T1 progeny of vector 24320, event number MZKE18200A028A, sample 12a.

SEQ ID NO: 399 is an edited nucleotide sequence from a T1 progeny of vector 24320, event number MZKE18200A028A, sample 12b.

SEQ ID NO: 400 is an edited nucleotide sequence from a T1 progeny of vector 24320, event number MZKE18200A028A, sample 13a.

SEQ ID NO: 401 is an edited nucleotide sequence from a T1 progeny of vector 24320, event number MZKE18200A028A, sample 13b.

SEQ ID NO: 402 is an edited nucleotide sequence from a T1 progeny of vector 24320, event number MZKE18200A028A, sample 14a.

SEQ ID NO: 403 is an edited nucleotide sequence from a T1 progeny of vector 24320, event number MZKE18200A028A, sample 14b.

SEQ ID NO: 404 is an edited nucleotide sequence from a T1 progeny of vector 24320, event number MZKE18200A028A, sample 15.

SEQ ID NO: 405 is an edited nucleotide sequence from a T1 progeny of vector 24320, event number MZKE18200A028A, sample 16a.

SEQ ID NO: 406 is an edited nucleotide sequence from a T1 progeny of vector 24320, event number MZKE18200A028A, sample 16b.

SEQ ID NO: 407 is an edited nucleotide sequence from a T1 progeny of vector 24320, event number MZKE18200A028A, sample 17a.

SEQ ID NO: 408 is an edited nucleotide sequence from a T1 progeny of vector 24320, event number MZKE18200A028A, sample 17b.

SEQ ID NO: 409 is an edited nucleotide sequence from a T1 progeny of vector 24320, event number MZKE18200A028A, sample 18a.

SEQ ID NO: 410 is an edited nucleotide sequence from a T1 progeny of vector 24320, event number MZKE18200A028A, sample 18b.

SEQ ID NO: 411 is an edited nucleotide sequence from a T1 progeny of vector 24320, event number MZKE18200A028A, sample 19a.

SEQ ID NO: 412 is an edited nucleotide sequence from a T1 progeny of vector 24320, event number MZKE18200A028A, sample 19b.

SEQ ID NO: 413 is an edited nucleotide sequence from a T1 progeny of vector 24320, event number MZKE18200A028A, sample 20a.

SEQ ID NO: 414 is an edited nucleotide sequence from a T1 progeny of vector 24320, event number MZKE18200A028A, sample 20b.

SEQ ID NO: 415 is an edited nucleotide sequence from a T1 progeny of vector 24320, event number MZKE18200A028A, sample 21a.

SEQ ID NO: 416 is an edited nucleotide sequence from a T1 progeny of vector 24320, event number MZKE18200A028A, sample 21b.

SEQ ID NO: 417 is an edited nucleotide sequence from a T1 progeny of vector 24320, event number MZKE18200A028A, sample 22a.

SEQ ID NO: 418 is an edited nucleotide sequence from a T1 progeny of vector 24320, event number MZKE18200A028A, sample 22b.

SEQ ID NO: 419 is an edited nucleotide sequence from a T1 progeny of vector 24320, event number MZKE18200A028A, sample 23a.

SEQ ID NO: 420 is an edited nucleotide sequence from a T1 progeny of vector 24320, event number MZKE18200A028A, sample 23b.

SEQ ID NO: 421 is an edited nucleotide sequence from a T1 progeny of vector 24320, event number MZKE18200A028A, sample 24a.

SEQ ID NO: 422 is an edited nucleotide sequence from a T1 progeny of vector 24320, event number MZKE18200A028A, sample 24b.

SEQ ID NO: 423 is an edited nucleotide sequence from a T1 progeny of vector 24320, event number MZKE18200A045A, sample 1a.

SEQ ID NO: 424 is an edited nucleotide sequence from a T1 progeny of vector 24320, event number MZKE18200A045A, sample 1b.

SEQ ID NO: 425 is an edited nucleotide sequence from a T1 progeny of vector 24320, event number MZKE18200A045A, sample 2a.

SEQ ID NO: 426 is an edited nucleotide sequence from a T1 progeny of vector 24320, event number MZKE18200A045A, sample 2b.

SEQ ID NO: 427 is an edited nucleotide sequence from a T1 progeny of vector 24320, event number MZKE18200A045A, sample 3a.

SEQ ID NO: 428 is an edited nucleotide sequence from a T1 progeny of vector 24320, event number MZKE18200A045A, sample 3b.

SEQ ID NO: 429 is an edited nucleotide sequence from a T1 progeny of vector 24320, event number MZKE18200A045A, sample 4a.

SEQ ID NO: 430 is an edited nucleotide sequence from a T1 progeny of vector 24320, event number MZKE18200A045A, sample 4b.

SEQ ID NO: 431 is an edited nucleotide sequence from a T1 progeny of vector 24320, event number MZKE18200A045A, sample 5a.

SEQ ID NO: 432 is an edited nucleotide sequence from a T1 progeny of vector 24320, event number MZKE18200A045A, sample 5b.

SEQ ID NO: 433 is an edited nucleotide sequence from a T1 progeny of vector 24320, event number MZKE18200A045A, sample 6.

SEQ ID NO: 434 is an edited nucleotide sequence from a T1 progeny of vector 24320, event number MZKE18200A045A, sample 7a.

SEQ ID NO: 435 is an edited nucleotide sequence from a T1 progeny of vector 24320, event number MZKE18200A045A, sample 7b.

SEQ ID NO: 436 is an edited nucleotide sequence from a T1 progeny of vector 24320, event number MZKE18200A045A, sample 8a.

SEQ ID NO: 437 is an edited nucleotide sequence from a T1 progeny of vector 24320, event number MZKE18200A045A, sample 8b.

SEQ ID NO: 438 is an edited nucleotide sequence from a T1 progeny of vector 24320, event number MZKE18200A045A, sample 9a.

SEQ ID NO: 439 is an edited nucleotide sequence from a T1 progeny of vector 24320, event number MZKE18200A045A, sample 9b.

SEQ ID NO: 440 is an edited nucleotide sequence from a T1 progeny of vector 24320, event number MZKE18200A045A, sample 10a.

SEQ ID NO: 441 is an edited nucleotide sequence from a T1 progeny of vector 24320, event number MZKE18200A045A, sample 10b.

SEQ ID NO: 442 is an edited nucleotide sequence from a T1 progeny of vector 24320, event number MZKE18200A045A, sample 11a.

SEQ ID NO: 443 is an edited nucleotide sequence from a T1 progeny of vector 24320, event number MZKE18200A045A, sample 11b.

SEQ ID NO: 444 is an edited nucleotide sequence from a T1 progeny of vector 24320, event number MZKE18200A045A, sample 12a.

SEQ ID NO: 445 is an edited nucleotide sequence from a T1 progeny of vector 24320, event number MZKE18200A045A, sample 12b.

SEQ ID NO: 446 is an edited nucleotide sequence from a T1 progeny of vector 24320, event number MZKE18200A045A, sample 13a.

SEQ ID NO: 447 is an edited nucleotide sequence from a T1 progeny of vector 24320, event number MZKE18200A045A, sample 13b.

SEQ ID NO: 448 is an edited nucleotide sequence from a T1 progeny of vector 24320, event number MZKE18200A045A, sample 14a.

SEQ ID NO: 449 is an edited nucleotide sequence from a T1 progeny of vector 24320, event number MZKE18200A045A, sample 14b.

SEQ ID NO: 450 is an edited nucleotide sequence from a T1 progeny of vector 24320, event number MZKE18200A045A, sample 15.

SEQ ID NO: 451 is an edited nucleotide sequence from a T1 progeny of vector 24320, event number MZKE18200A045A, sample 16a.

SEQ ID NO: 452 is an edited nucleotide sequence from a T1 progeny of vector 24320, event number MZKE18200A045A, sample 16b.

SEQ ID NO: 453 is an edited nucleotide sequence from a T1 progeny of vector 24320, event number MZKE18200A045A, sample 17.

SEQ ID NO: 454 is an edited nucleotide sequence from a T1 progeny of vector 24320, event number MZKE18200A045A, sample 18a.

SEQ ID NO: 455 is an edited nucleotide sequence from a T1 progeny of vector 24320, event number MZKE18200A045A, sample 18b.

SEQ ID NO: 456 is an edited nucleotide sequence from a T1 progeny of vector 24320, event number MZKE18200A045A, sample 19.

SEQ ID NO: 457 is an edited nucleotide sequence from a T1 progeny of vector 24320, event number MZKE18200A057A, sample 1a.

SEQ ID NO: 458 is an edited nucleotide sequence from a T1 progeny of vector 24320, event number MZKE18200A057A, sample 1b.

SEQ ID NO: 459 is an edited nucleotide sequence from a T1 progeny of vector 24320, event number MZKE18200A057A, sample 2a.

SEQ ID NO: 460 is an edited nucleotide sequence from a T1 progeny of vector 24320, event number MZKE18200A057A, sample 2b.

SEQ ID NO: 461 is an edited nucleotide sequence from a T1 progeny of vector 24320, event number MZKE18200A057A, sample 3a.

SEQ ID NO: 462 is an edited nucleotide sequence from a T1 progeny of vector 24320, event number MZKE18200A057A, sample 3b.

SEQ ID NO: 463 is an edited nucleotide sequence from a T1 progeny of vector 24320, event number MZKE18200A057A, sample 4.

SEQ ID NO: 464 is an edited nucleotide sequence from a T1 progeny of vector 24320, event number MZKE18200A057A, sample 4a.

SEQ ID NO: 465 is an edited nucleotide sequence from a T1 progeny of vector 24320, event number MZKE18200A057A, sample 4b.

SEQ ID NO: 466 is an edited nucleotide sequence from a T1 progeny of vector 24320, event number MZKE18200A057A, sample 5.

SEQ ID NO: 467 is an edited nucleotide sequence from a T1 progeny of vector 24320, event number MZKE18200A057A, sample 6a.

SEQ ID NO: 468 is an edited nucleotide sequence from a T1 progeny of vector 24320, event number MZKE18200A057A, sample 6b.

SEQ ID NO: 469 is an edited nucleotide sequence from a T1 progeny of vector 24320, event number MZKE18200A057A, sample 7.

SEQ ID NO: 470 is an edited nucleotide sequence from a T1 progeny of vector 24320, event number MZKE18200A057A, sample 8.

SEQ ID NO: 471 is an edited nucleotide sequence from a T1 progeny of vector 24320, event number MZKE18200A057A, sample 9a.

SEQ ID NO: 472 is an edited nucleotide sequence from a T1 progeny of vector 24320, event number MZKE18200A057A, sample 9b.

SEQ ID NO: 473 is an edited nucleotide sequence from a T1 progeny of vector 24320, event number MZKE18200A057A, sample 10a.

SEQ ID NO: 474 is an edited nucleotide sequence from a T1 progeny of vector 24320, event number MZKE18200A057A, sample 10b.

SEQ ID NO: 475 is an edited nucleotide sequence from a T1 progeny of vector 24320, event number MZKE18200A057A, sample 11a.

SEQ ID NO: 476 is an edited nucleotide sequence from a T1 progeny of vector 24320, event number MZKE18200A057A, sample 11b.

SEQ ID NO: 477 is an edited nucleotide sequence from a T1 progeny of vector 24320, event number MZKE18200A057A, sample 12a.

SEQ ID NO: 478 is an edited nucleotide sequence from a T1 progeny of vector 24320, event number MZKE18200A057A, sample 12b.

SEQ ID NO: 479 is an edited nucleotide sequence from a T1 progeny of vector 24320, event number MZKE18200A064A, sample 1a.

SEQ ID NO: 480 is an edited nucleotide sequence from a T1 progeny of vector 24320, event number MZKE18200A064A, sample 1b.

SEQ ID NO: 481 is an edited nucleotide sequence from a T1 progeny of vector 24320, event number MZKE18200A064A, sample 2a.

SEQ ID NO: 482 is an edited nucleotide sequence from a T1 progeny of vector 24320, event number MZKE18200A064A, sample 2b.

SEQ ID NO: 483 is an edited nucleotide sequence from a T1 progeny of vector 24320, event number MZKE18200A064A, sample 3a.

SEQ ID NO: 484 is an edited nucleotide sequence from a T1 progeny of vector 24320, event number MZKE18200A064A, sample 3b.

SEQ ID NO: 485 is an edited nucleotide sequence from a T1 progeny of vector 24320, event number MZKE18200A064A, sample 4a.

SEQ ID NO: 486 is an edited nucleotide sequence from a T1 progeny of vector 24320, event number MZKE18200A064A, sample 4b.

SEQ ID NO: 487 is an edited nucleotide sequence from a T1 progeny of vector 24320, event number MZKE18200A064A, sample 5a.

SEQ ID NO: 488 is an edited nucleotide sequence from a T1 progeny of vector 24320, event number MZKE18200A064A, sample 5b.

SEQ ID NO: 489 is an edited nucleotide sequence from a T1 progeny of vector 24320, event number MZKE18200A064A, sample 6.

SEQ ID NO: 490 is an edited nucleotide sequence from a T1 progeny of vector 24320, event number MZKE18200A064A, sample 7a.

SEQ ID NO: 491 is an edited nucleotide sequence from a T1 progeny of vector 24320, event number MZKE18200A064A, sample 7b.

SEQ ID NO: 492 is an edited nucleotide sequence from a T1 progeny of vector 24320, event number MZKE18200A064A, sample 8a.

SEQ ID NO: 493 is an edited nucleotide sequence from a T1 progeny of vector 24320, event number MZKE18200A064A, sample 8b.

SEQ ID NO: 494 is an edited nucleotide sequence from a T1 progeny of vector 24320, event number MZKE18200A064A, sample 9a.

SEQ ID NO: 495 is an edited nucleotide sequence from a T1 progeny of vector 24320, event number MZKE18200A064A, sample 9b.

SEQ ID NO: 496 is an edited nucleotide sequence from a T1 progeny of vector 24320, event number MZKE18200A064A, sample 10a.

SEQ ID NO: 497 is an edited nucleotide sequence from a T1 progeny of vector 24320, event number MZKE18200A064A, sample 10b.

SEQ ID NO: 498 is an edited nucleotide sequence from a T1 progeny of vector 24320, event number MZKE18200A064A, sample 11.

SEQ ID NO: 499 is an edited nucleotide sequence from a T1 progeny of vector 24320, event number MZKE18200A064A, sample 12a.

SEQ ID NO: 500 is an edited nucleotide sequence from a T1 progeny of vector 24320, event number MZKE18200A064A, sample 12b.

SEQ ID NO: 501 is an edited nucleotide sequence from a T1 progeny of vector 24320, event number MZKE18200A064A, sample 13a.

SEQ ID NO: 502 is an edited nucleotide sequence from a T1 progeny of vector 24320, event number MZKE18200A064A, sample 13b.

SEQ ID NO: 503 is an edited nucleotide sequence from a T1 progeny of vector 24320, event number MZKE18200A064A, sample 14a.

SEQ ID NO: 504 is an edited nucleotide sequence from a T1 progeny of vector 24320, event number MZKE18200A064A, sample 14b.

SEQ ID NO: 505 is an edited nucleotide sequence from a T1 progeny of vector 24320, event number MZKE18200A064A, sample 15a.

SEQ ID NO: 506 is an edited nucleotide sequence from a T1 progeny of vector 24320, event number MZKE18200A064A, sample 15b.

SEQ ID NO: 507 is an edited nucleotide sequence from a T1 progeny of vector 24320, event number MZKE18200A064A, sample 16a.

SEQ ID NO: 508 is an edited nucleotide sequence from a T1 progeny of vector 24320, event number MZKE18200A064A, sample 16b.

SEQ ID NO: 509 is an edited nucleotide sequence from a T1 progeny of vector 24320, event number MZKE18200A064A, sample 17a.

SEQ ID NO: 510 is an edited nucleotide sequence from a T1 progeny of vector 24320, event number MZKE18200A064A, sample 17b.

SEQ ID NO: 511 is an edited nucleotide sequence from a T1 progeny of vector 24320, event number MZKE18200A064A, sample 18a.

SEQ ID NO: 512 is an edited nucleotide sequence from a T1 progeny of vector 24320, event number MZKE18200A064A, sample 18b.

SEQ ID NO: 513 is a nucleotide sequence for vector 24857.

SEQ ID NO: 514 is a nucleotide sequence for prGm-MADS28-01, an FMOS promoter in soy.

SEQ ID NO: 515 is a nucleotide sequence for tGm-MADS28-01, an FMOS terminator in soy.

SEQ ID NO: 516 is a nucleotide sequence for vector 24905, containing a soy constitutive promoter (control).

SEQ ID NO: 517 is a nucleotide sequence for vector 24925.

SEQ ID NO: 518 is a nucleotide sequence for prGmMMD1-01, an FMOS promoter in soy.

SEQ ID NO: 519 is a nucleotide sequence for tGmMMD1-01, an FMOS terminator in soy.

SEQ ID NO: 520 is a nucleotide sequence for gRNA1 in vectors 24857 and 24905 targeting the first exon in GmCenH3 in soybean.

SEQ ID NO: 521 is a nucleotide sequence for gRNA2 in vectors 24857 and 24905 targeting the 4th exon in GmCenH3 in soybean.

SEQ ID NO: 522 is a nucleotide sequence for a sense primer in a CP4 assay.

SEQ ID NO: 523 is a nucleotide sequence for an antisense primer in a CP4 assay.

SEQ ID NO: 524 is a nucleotide sequence for a probe in a CP4 assay.

SEQ ID NO: 525 is a nucleotide sequence for a sense primer in a Cas assay.

SEQ ID NO: 526 is a nucleotide sequence for an antisense primer in a Cas assay.

SEQ ID NO: 527 is a nucleotide sequence for a probe in a Cas assay.

SEQ ID NO: 528 is a nucleotide sequence for a forward primer in a Cas assay.

SEQ ID NO: 529 is a nucleotide sequence for a reverse primer in a Cas assay.

SEQ ID NO: 530 is a nucleotide sequence for a probe in a Cas assay.

SEQ ID NO: 531 is a nucleotide sequence for Intron iUbi1-07 of ubiquitin promoter prUbi1-18.

SEQ ID NO: 532 is a nucleotide sequence for Cas12a.

SEQ ID NO: 533 is a nucleotide sequence for vector 25053.

SEQ ID NO: 534 is a nucleotide sequence for vector 25074.

SEQ ID NO: 535 is a nucleotide sequence for vector 25068.

SEQ ID NO: 536 is a nucleotide sequence for vector 25069.

SEQ ID NO: 537 is a nucleotide sequence for vector 24997.

SEQ ID NO: 538 is a nucleotide sequence for vector 25002.

SEQ ID NO: 539 is a nucleotide sequence for vector 25003.

SEQ ID NO: 540 is a nucleotide sequence for vector 25004.

SEQ ID NO: 541 is a nucleotide sequence for vector 25005.

SEQ ID NO: 542 is a nucleotide sequence for vector 25006.

SEQ ID NO: 543 is a nucleotide sequence for vector 25007.

SEQ ID NO: 544 is a nucleotide sequence for vector 25008.

SEQ ID NO: 545 is a nucleotide sequence for vector 25009.

SEQ ID NO: 546 is a nucleotide sequence for a primer for Adh1 editing analysis.

SEQ ID NO: 547 is a nucleotide sequence for a primer for Adh1 editing analysis.

SEQ ID NO: 548 is a nucleotide sequence used for Adh1 target reference.

SEQ ID NO: 549 is an edited nucleotide sequence from a T1 progeny of vector 25002, event number GVG01189803, plant 1.

SEQ ID NO: 550 is an edited nucleotide sequence from a T1 progeny of vector 25002, event number GVG01189803, plant 1.

SEQ ID NO: 551 is an edited nucleotide sequence from a T1 progeny of vector 25002, event number GVG01189803, plant 2.

SEQ ID NO: 552 is an edited nucleotide sequence from a T1 progeny of vector 25002, event number GVG01189803, plant 2.

SEQ ID NO: 553 is an edited nucleotide sequence from a T1 progeny of vector 25002, event number GVG01189803, plant 3.

SEQ ID NO: 554 is an edited nucleotide sequence from a T1 progeny of vector 25002, event number GVG01189803, plant 3.

SEQ ID NO: 555 is an edited nucleotide sequence from a T1 progeny of vector 25002, event number GVG01189803, plant 4.

SEQ ID NO: 556 is an edited nucleotide sequence from a T1 progeny of vector 25002, event number GVG01189803, plant 4.

SEQ ID NO: 557 is an edited nucleotide sequence from a T1 progeny of vector 25002, event number GVG01189803, plant 5.

SEQ ID NO: 558 is an edited nucleotide sequence from a T1 progeny of vector 25002, event number GVG01189803, plant 6.

SEQ ID NO: 559 is an edited nucleotide sequence from a T1 progeny of vector 25002, event number GVG01189803, plant 6.

SEQ ID NO: 560 is an edited nucleotide sequence from a T1 progeny of vector 25002, event number GVG01189803, plant 7.

SEQ ID NO: 561 is an edited nucleotide sequence from a T1 progeny of vector 25002, event number GVG01189803, plant 7.

SEQ ID NO: 562 is an edited nucleotide sequence from a T1 progeny of vector 25002, event number GVG01189803, plant 8.

SEQ ID NO: 563 is an edited nucleotide sequence from a T1 progeny of vector 25002, event number GVG01189803, plant 8.

SEQ ID NO: 564 is an edited nucleotide sequence from a T1 progeny of vector 25002, event number GVG01189803, plant 9.

SEQ ID NO: 565 is an edited nucleotide sequence from a T1 progeny of vector 25002, event number GVG01189803, plant 9.

SEQ ID NO: 566 is an edited nucleotide sequence from a T1 progeny of vector 25002, event number GVG01189803, plant 10.

SEQ ID NO: 567 is an edited nucleotide sequence from a T1 progeny of vector 25002, event number GVG01189803, plant 10.

SEQ ID NO: 568 is an edited nucleotide sequence from a T1 progeny of vector 25002, event number GVG01189803, plant 11.

SEQ ID NO: 569 is an edited nucleotide sequence from a T1 progeny of vector 25002, event number GVG01189803, plant 11.

SEQ ID NO: 570 is an edited nucleotide sequence from a T1 progeny of vector 25002, event number GVG01189803, plant 12.

SEQ ID NO: 571 is an edited nucleotide sequence from a T1 progeny of vector 25002, event number GVG01189803, plant 12.

SEQ ID NO: 572 is an edited nucleotide sequence from a T1 progeny of vector 25002, event number GVG01189803, plant 13.

SEQ ID NO: 573 is an edited nucleotide sequence from a T1 progeny of vector 25002, event number GVG01189803, plant 13.

SEQ ID NO: 574 is an edited nucleotide sequence from a T1 progeny of vector 25002, event number GVG01189803, plant 13.

SEQ ID NO: 575 is an edited nucleotide sequence from a T1 progeny of vector 25002, event number GVG01189803, plant 14.

SEQ ID NO: 576 is an edited nucleotide sequence from a T1 progeny of vector 25002, event number GVG01189803, plant 14.

SEQ ID NO: 577 is an edited nucleotide sequence from a T1 progeny of vector 25002, event number GVG01189803, plant 15.

SEQ ID NO: 578 is an edited nucleotide sequence from a T1 progeny of vector 25002, event number GVG01189803, plant 16.

SEQ ID NO: 579 is an edited nucleotide sequence from a T1 progeny of vector 25002, event number GVG01189803, plant 16.

SEQ ID NO: 580 is an edited nucleotide sequence from a T1 progeny of vector 25002, event number GVG01189803, plant 17.

SEQ ID NO: 581 is an edited nucleotide sequence from a T1 progeny of vector 25002, event number GVG01189803, plant 17.

SEQ ID NO: 582 is an edited nucleotide sequence from a T1 progeny of vector 25002, event number GVG01189803, plant 18.

SEQ ID NO: 583 is an edited nucleotide sequence from a T1 progeny of vector 25002, event number GVG01189803, plant 19.

SEQ ID NO: 584 is an edited nucleotide sequence from a T1 progeny of vector 25002, event number GVG01189803, plant 20.

SEQ ID NO: 585 is an edited nucleotide sequence from a T1 progeny of vector 25002, event number GVG01189803, plant 20.

SEQ ID NO: 586 is an edited nucleotide sequence from a T1 progeny of vector 25002, event number GVG01189803, plant 21.

SEQ ID NO: 587 is an edited nucleotide sequence from a T1 progeny of vector 25002, event number GVG01189803, plant 22.

SEQ ID NO: 588 is an edited nucleotide sequence from a T1 progeny of vector 25002, event number GVG01189803, plant 22.

SEQ ID NO: 589 is an edited nucleotide sequence from a T1 progeny of vector 25002, event number GVG01189803, plant 23.

SEQ ID NO: 590 is an edited nucleotide sequence from a T1 progeny of vector 25002, event number GVG01189803, plant 23.

SEQ ID NO: 591 is an edited nucleotide sequence from a T1 progeny of vector 25002, event number GVG01189803, plant 24.

SEQ ID NO: 592 is an edited nucleotide sequence from a T1 progeny of vector 25002, event number GVG01189803, plant 24.

SEQ ID NO: 593 is an edited nucleotide sequence from a T1 progeny of vector 25002, event number GVG01189803, plant 25.

SEQ ID NO: 594 is an edited nucleotide sequence from a T1 progeny of vector 25002, event number GVG01189803, plant 26.

SEQ ID NO: 595 is an edited nucleotide sequence from a T1 progeny of vector 25002, event number GVG01189803, plant 27.

SEQ ID NO: 596 is an edited nucleotide sequence from a T1 progeny of vector 25002, event number GVG01189803, plant 27.

SEQ ID NO: 597 is an edited nucleotide sequence from a T1 progeny of vector 25002, event number GVG01189803, plant 28.

SEQ ID NO: 598 is an edited nucleotide sequence from a T1 progeny of vector 25002, event number GVG01189803, plant 28.

SEQ ID NO: 599 is an edited nucleotide sequence from a T1 progeny of vector 25002, event number GVG01189803, plant 29.

SEQ ID NO: 600 is an edited nucleotide sequence from a T1 progeny of vector 25002, event number GVG01189803, plant 30.

SEQ ID NO: 601 is an edited nucleotide sequence from a T1 progeny of vector 25002, event number GVG01189803, plant 30.

SEQ ID NO: 602 is an edited nucleotide sequence from a T1 progeny of vector 25002, event number GVG01189803, plant 31.

SEQ ID NO: 603 is an edited nucleotide sequence from a T1 progeny of vector 25002, event number GVG01189803, plant 31.

SEQ ID NO: 604 is an edited nucleotide sequence from a T1 progeny of vector 25002, event number GVG01189803, plant 32.

SEQ ID NO: 605 is an edited nucleotide sequence from a T1 progeny of vector 25002, event number GVG01189803, plant 32.

SEQ ID NO: 606 is an edited nucleotide sequence from a T1 progeny of vector 25002, event number GVG01189803, plant 33.

SEQ ID NO: 607 is an edited nucleotide sequence from a T1 progeny of vector 25002, event number GVG01189803, plant 33.

SEQ ID NO: 608 is an edited nucleotide sequence from a T1 progeny of vector 25002, event number GVG01189803, plant 34.

SEQ ID NO: 609 is an edited nucleotide sequence from a T1 progeny of vector 25002, event number GVG01189803, plant 34.

SEQ ID NO: 610 is an edited nucleotide sequence from a T1 progeny of vector 25002, event number GVG01189803, plant 35.

SEQ ID NO: 611 is an edited nucleotide sequence from a T1 progeny of vector 25002, event number GVG01189803, plant 36.

SEQ ID NO: 612 is a nucleotide sequence for vector Cr-X-FMOS containing a modified Cas.

SEQ ID NO: 613 is a nucleotide sequence for vector Ev-FMOS containing a modified Cas.

SEQ ID NO: 614 is a nucleotide sequence encoding a modified version of prZmAP1 used in 24997.

SEQ ID NO: 615 is a nucleotide sequence encoding a modified version of prZmBde1 used in 25002.

SEQ ID NO: 616 is a nucleotide sequence encoding a modified version of prZmBde1 used in 25003.

SEQ ID NO: 617 is a nucleotide sequence encoding a modified version of prZmBde1 used in 25004.

SEQ ID NO: 618 is a nucleotide sequence encoding a modified version of prZmBde1 used in 25005.

SEQ ID NO: 619 is a nucleotide sequence encoding a modified version of prZmBde1 used in 25006.

SEQ ID NO: 620 is a nucleotide sequence encoding a modified version of prOsAP1 used in 25007.

SEQ ID NO: 621 is a nucleotide sequence encoding a modified version of prOsAP1 used in 25008.

SEQ ID NO: 622 is a nucleotide sequence encoding a modified version of prOsAP1 used in 25009.

SEQ ID NO: 623 is a nucleotide sequence encoding a modified version of an intron in prZmAP1-03.

SEQ ID NO: 624 is a nucleotide sequence encoding a modified version of an intron in prZmBde1-03. and prZmBde1-07.

SEQ ID NO: 625 is a nucleotide sequence encoding a modified version of an intron in prZmBde1-04.

SEQ ID NO: 626 is a nucleotide sequence encoding a modified version of an intron in prZmBde1-05.

SEQ ID NO: 627 is a nucleotide sequence encoding a modified version of an intron in prOsAP1-02 and prOsAP1-04.

SEQ ID NO: 628 is a nucleotide sequence for a forward primer for CENH3 editing analysis.

SEQ ID NO: 629 is a nucleotide sequence for a reverse primer for CENH3 editing analysis.

SEQ ID NO: 630 is a nucleotide sequence for a forward primer for CENH3 editing analysis.

SEQ ID NO: 631 is a wildtype nucleotide sequence for a gRNA2 target of construct 24905.

SEQ ID NO: 632 is an edited nucleotide sequence for a gRNA2 target of construct 24905.

SEQ ID NO: 633 is a nucleotide target sequence for Chalcone synthase (WHP1), Target 1.

SEQ ID NO: 634 is a nucleotide target sequence for Chalcone synthase (C2), Target 1.

SEQ ID NO: 635 is a nucleotide target sequence for Chalcone synthase (WHP1), Target 2.

SEQ ID NO: 636 is a nucleotide target sequence for Chalcone synthase (C2), Target 2.

SEQ ID NO: 637 is a nucleotide sequence for primer 1 for WHP1, Target 1.

SEQ ID NO: 638 is a nucleotide sequence for primer 2 for WHP1, Target 1.

SEQ ID NO: 639 is a nucleotide sequence for a probe for WHP1, Target 1.

SEQ ID NO: 640 is a nucleotide sequence for primer 1 for C2, Target 1.

SEQ ID NO: 641 is a nucleotide sequence for primer 2 for C2, Target 1.

SEQ ID NO: 642 is a nucleotide sequence for a probe for C2, Target 1.

SEQ ID NO: 643 is a nucleotide sequence for primer 1 for WHP1, Target 2.

SEQ ID NO: 644 is a nucleotide sequence for primer 2 for WHP1, Target 2.

SEQ ID NO: 645 is a nucleotide sequence for a probe for WHP1, Target 2.

SEQ ID NO: 646 is a nucleotide sequence for primer 1 for C2, Target 2.

SEQ ID NO: 647 is a nucleotide sequence for primer 2 for C2, Target 2.

SEQ ID NO: 648 is a nucleotide sequence for a probe for C2, Target 2.

SEQ ID NO: 649 is a nucleotide sequence for a forward primer for a PMI assay.

SEQ ID NO: 650 is a nucleotide sequence for a reverse primer for a PMI assay.

SEQ ID NO: 651 is a nucleotide sequence for a probe for PMI assay.

SEQ ID NO: 652 is a nucleotide sequence for a forward primer for the control gene ZmEF1 assay.

SEQ ID NO: 653 is a nucleotide sequence for a reverse primer for the control gene ZmEF1 assay.

SEQ ID NO: 654 is a nucleotide sequence for a probe for the control gene ZmEF1 assay.

SEQ ID NO: 655 is a WT nucleotide sequence for gRNA2 target in construct 24905.

SEQ ID NO: 656 is an edited nucleotide sequence from a T0 plant transformed with construct 24905.

SEQ ID NO: 657 is a nucleotide sequence for vector 24925.

SEQ ID NO: 658 is a deleted nucleotide sequence in soy.
SEQ ID NO: 659 is a deleted nucleotide sequence in soy.
SEQ ID NO: 660 is a deleted nucleotide sequence in soy.
SEQ ID NO: 661 is a deleted nucleotide sequence in soy.
SEQ ID NO: 662 is a WT nucleotide sequence in soy.
SEQ ID NO: 663 is an edited nucleotide sequence in soy.
SEQ ID NO: 664 is an edited nucleotide sequence in soy.
SEQ ID NO: 665 is an edited nucleotide sequence in soy.
SEQ ID NO: 666 is an edited nucleotide sequence in soy.
SEQ ID NO: 667 is a WT nucleotide sequence in soy.
SEQ ID NO: 668 is an edited nucleotide sequence in soy.
SEQ ID NO: 669 is an edited nucleotide sequence in soy.
SEQ ID NO: 670 is an edited nucleotide sequence in soy.
SEQ ID NO: 671 is an edited nucleotide sequence in soy.
SEQ ID NO: 672 is a WT nucleotide sequence in soy.
SEQ ID NO: 673 is an edited nucleotide sequence in soy.
SEQ ID NO: 674 is an edited nucleotide sequence in soy.
SEQ ID NO: 675 is an edited nucleotide sequence in soy.
SEQ ID NO: 676 is an edited nucleotide sequence in soy.
SEQ ID NO: 677 is an edited nucleotide sequence in soy.
SEQ ID NO: 678 is an edited nucleotide sequence in soy.
SEQ ID NO: 679 is an edited nucleotide sequence in soy.
SEQ ID NO: 680 is an edited nucleotide sequence in soy.
SEQ ID NO: 681 is an edited nucleotide sequence in soy.
SEQ ID NO: 682 is an edited nucleotide sequence in soy.
SEQ ID NO: 683 is a WT nucleotide sequence in soy.
SEQ ID NO: 684 is an edited nucleotide sequence in soy.
SEQ ID NO: 685 is an edited nucleotide sequence in soy.
SEQ ID NO: 686 is an edited nucleotide sequence in soy.
SEQ ID NO: 687 is an edited nucleotide sequence in soy.
SEQ ID NO: 688 is an edited nucleotide sequence in soy.
SEQ ID NO: 689 is an edited nucleotide sequence in soy.
SEQ ID NO: 690 is an edited nucleotide sequence in soy.
SEQ ID NO: 691 is an edited nucleotide sequence in soy.
SEQ ID NO: 692 is an edited nucleotide sequence in soy.
SEQ ID NO: 693 is an edited nucleotide sequence in soy.
SEQ ID NO: 694 is an edited nucleotide sequence in soy.
SEQ ID NO: 695 is an edited nucleotide sequence in soy.
SEQ ID NO: 696 is an edited nucleotide sequence in soy SEQ ID NO: 697 is a nucleotide sequence for vector AR-SDN2_RETRON.

SEQ ID NO: 698 is the nucleotide sequence encoding promoter prAtAPETALA1-01.

SEQ ID NO: 699 is the nucleotide sequence encoding terminator tAtAPETALA1-01.

SEQ ID NO: 700 is the nucleotide sequence encoding promoter prAtSEPELLATA2-01.

SEQ ID NO: 701 is the nucleotide sequence encoding terminator tAtSEPELLATA2-01.

SEQ ID NO: 702 is the nucleotide sequence encoding promoter prMMD1-01.

SEQ ID NO: 703 is the nucleotide sequence encoding terminator tMMD1-01.

SEQ ID NO: 704 is the nucleotide sequence encoding promoter prSILOXA-01 (tomato).

SEQ ID NO: 705 is the nucleotide sequence encoding terminator prSILOXA-01 (tomato).

SEQ ID NO: 706 is the nucleotide sequence encoding promoter prSITM5-01.

SEQ ID NO: 707 is the nucleotide sequence encoding terminator tSITM5-01.

SEQ ID NO: 708 is the nucleotide sequence encoding promoter prSITM29-01.

SEQ ID NO: 709 is the nucleotide sequence encoding terminator tSITM29-01.

SEQ ID NO: 710 is the nucleotide sequence encoding promoter prGmMMD1-02 (enhanced).

SEQ ID NO: 711 is the nucleotide sequence encoding first enhancer of prGmMMD1-02.

SEQ ID NO: 712 is the nucleotide sequence encoding second enhancer of prGmMMD1-02.

SEQ ID NO: 713 is the nucleotide sequence encoding third enhancer of prGmMMD1-02.

SEQ ID NO: 714 is the nucleotide sequence encoding a gRNA.

SEQ ID NO: 715 is the nucleotide sequence encoding a gRNA.

SEQ ID NO: 716 is the nucleotide sequence encoding a gRNA targeting tomato ADH1 gene.

SEQ ID NO: 717 is the nucleotide sequence encoding prZmMSCA1-01.

SEQ ID NO: 718 is the nucleotide sequence encoding tZmMSCA1-01.

SEQ ID NO: 719 is the nucleotide sequence encoding prZmPPG4-01.

SEQ ID NO: 720 is the nucleotide sequence encoding tZmPPG4-01.

SEQ ID NO: 721 is the nucleotide sequence encoding the promoter for NADH dehydrogenase.

SEQ ID NO: 722 is the nucleotide sequence encoding the terminator for NADH dehydrogenase.

SEQ ID NO: 723 is the nucleotide sequence encoding prZmCID11.

SEQ ID NO: 724 is the nucleotide sequence encoding tZmCID11.

BRIEF DESCRIPTION OF THE FIGURES

FIG. 3 is a schematic drawing of Vector 24224 (SEQ ID NO: 10) used for transformation of maize immature embryos.

FIG. 4 is a schematic drawing of Vector 24243 (SEQ ID NO: 40) used for transformation of maize immature embryos.

FIG. 5 is a schematic drawing of Vector 24265 (SEQ ID NO: 19) used for transformation of maize immature embryos.

FIG. 6 is a schematic drawing of Vector 24266 (SEQ ID NO: 22) used for transformation of maize immature embryos.

FIG. 7 is a schematic drawing of Vector 24269 (SEQ ID NO: 25) used for transformation of maize immature embryos.

FIG. 8 is a schematic drawing of Vector 24270 (SEQ ID NO: 28) used for transformation of maize immature embryos.

FIG. 9 is a schematic drawing of Vector 24289 (SEQ ID NO: 31) used for transformation of maize immature embryos.

FIG. 10 is a schematic drawing of Vector 24299 (SEQ ID NO: 34) used for transformation of maize immature embryos.

FIG. 11 is a schematic drawing of Vector 24300 (SEQ ID NO: 85) used for transformation of maize immature embryos.

FIG. 12 is a schematic drawing of Vector 24305 (SEQ ID NO: 43) used for transformation of maize immature embryos.

FIG. 13 is a schematic drawing of Vector 24306 (SEQ ID NO: 46) used for transformation of maize immature embryos.

FIG. 14 is a schematic drawing of Vector 24320 (SEQ ID NO: 49) used for transformation of maize immature embryos.

FIG. 15 is a schematic drawing of Vector 24426 (SEQ ID NO: 52) used for transformation of maize immature embryos.

FIG. 16 is a schematic drawing of Vector 24427 (SEQ ID NO: 55) used for transformation of maize immature embryos.

FIG. 17 is a schematic drawing of Vector 24428 (SEQ ID NO: 58) used for transformation of maize immature embryos.

FIG. 18 is a schematic drawing of Vector 24454 (SEQ ID NO: 61) used for transformation of maize immature embryos.

FIG. 19 is a schematic drawing of Vector 24455 (SEQ ID NO: 64) used for transformation of maize immature embryos.

FIG. 20 is a schematic drawing of Vector 24458 (SEQ ID NO: 67) used for transformation of maize immature embryos.

FIG. 21 is a schematic drawing of Vector 24459 (SEQ ID NO: 70) used for transformation of maize immature embryos.

FIG. 22 is a schematic drawing of Vector 24460 (SEQ ID NO: 73) used for transformation of maize immature embryos.

FIG. 23 is a schematic drawing of Vector 24548 (SEQ ID NO: 76) used for transformation of maize immature embryos.

FIG. 24 is a schematic drawing of Vector 24602 (SEQ ID NO: 79) used for transformation of maize immature embryos.

FIG. 25 is a schematic drawing of Vector 24688 (SEQ ID NO: 82) used for transformation of maize immature embryos.

FIG. 26 illustrates a tassel sampling plan.

FIG. 27 illustrates at least one expression cassette having one gRNA target site flanking the donor DNA.

FIG. 28 illustrates at least one expression cassette having two gRNA target sites flanking the donor DNA.

FIG. 29 illustrates at least one expression cassette having no gRNA target sites flanking the donor DNA.

FIG. 30 illustrates another embodiment of at least one expression cassette.

FIG. 31 is a schematic drawing of Vector AR-SDN2_REP_1 Cut (SEQ ID NO: 188) used for transformation of maize immature embryos.

FIG. 32 is a schematic drawing of Vector AR-SDN2_REP_2 Cuts (SEQ ID NO: 187) used for transformation of maize immature embryos.

FIG. 33 is a schematic drawing of Vector AR-SDN2_REP_NoCut (SEQ ID NO: 186) used for transformation of maize immature embryos.

FIG. 40 illustrates sequence alignments showing a plurality of unique edits in T1 seed.

FIG. 44 is a schematic drawing of Vector AR-SDN2_RETRON (SEQ ID NO: 697) used for transformation of maize immature embryos.

DEFINITIONS

Figure 1:
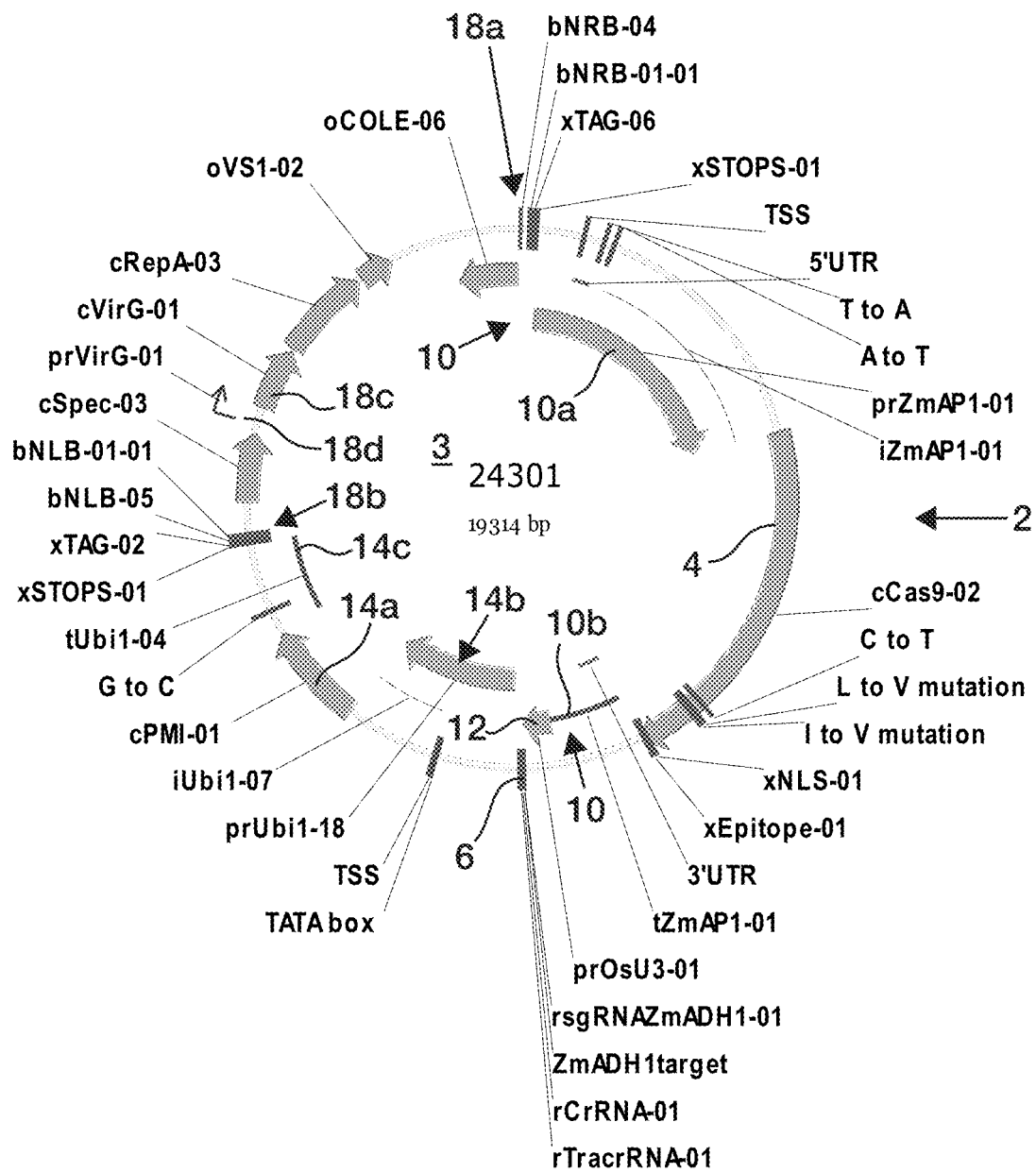
FIG. 1 is a schematic drawing of Vector 24301 (SEQ ID NO: 1) used for transformation of maize immature embryos.

While the following terms are believed to be well understood by one of ordinary skill in the art, the following definitions are set forth to facilitate explanation of the presently disclosed subject matter.

All technical and scientific terms used herein, unless otherwise defined below, are intended to have the same meaning as commonly understood by one of ordinary skill in the art. References to techniques employed herein are intended to refer to the techniques as commonly understood in the art, including variations on those techniques and/or substitutions of equivalent techniques that would be apparent to one of skill in the art. While the following terms are believed to be well understood by one of ordinary skill in the art, the following definitions are set forth to facilitate explanation of the presently disclosed subject matter.

Following long-standing patent law convention, the terms "a," "an," and "the" refer to "one or more" when used in this application, including the claims. For example, the phrase "a cell" refers to one or more cells, and in some embodiments can refer to a tissue and/or an organ. Similarly, the phrase "at least one", when employed herein to refer to an entity, refers to, for example, 1, 2, 3, 4, 5, 6, 7, 8, 9, 10, 15, 20, 25, 30, 35, 40, 45, 50, 75, 100, or more of that entity, including but not limited to all whole number values between 1 and 100 as well as whole numbers greater than 100.

Unless otherwise indicated, all numbers expressing quantities of ingredients, reaction conditions, and so forth used in the specification and claims are to be understood as being modified in all instances by the term "about." The term "about," as used herein when referring to a measurable value such as an amount of mass, weight, time, volume, concentration or percentage is meant to encompass variations of in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed methods and/or employ the discloses compositions, nucleic acids, polypeptides, etc. Accordingly, unless indicated to the contrary, the numerical parameters set forth in this specification and attached claims are approximations that can vary depending upon the desired properties sought to be obtained by the presently disclosed subject matter.

As used herein, the term "allele" refers to a variant or an alternative sequence form at a genetic locus. In diploids, a single allele is inherited by a progeny individual separately from each parent at each locus. The two alleles of a given locus present in a diploid organism occupy corresponding places on a pair of homologous chromosomes, although one of ordinary skill in the art understands that the alleles in any particular individual do not necessarily represent all of the alleles that are present in the species.

As used herein, the term "and/or" when used in the context of a list of entities, refers to the entities being present singly or in combination. Thus, for example, the phrase "A, B, C, and/or D" includes A, B, C, and D individually, but also includes any and all combinations and subcombinations of A, B, C, and D (e.g., AB, AC, AD, BC, BD, CD, ABC, ABD, and BCD). In some embodiments, one of more of the elements to which the "and/or" refers can also individually be present in single or multiple occurrences in the combinations(s) and/or subcombination(s).

As used herein, the phrase "associated with" refers to a recognizable and/or assayable relationship between two entities. For example, the phrase "associated with HI" refers to a trait, locus, gene, allele, marker, phenotype, etc., or the expression thereof, the presence or absence of which can influence an extent and/or degree at which a plant or its progeny exhibits HI or haploid induction. As such, a marker is "associated with" a trait when it is linked to it and when the presence of the marker is an indicator of whether and/or to what extent the desired trait or trait form will occur in a plant/germplasm comprising the marker. Similarly, a marker is "associated with" an allele when it is linked to it and when the presence of the marker is an indicator of whether the allele is present in a plant/germplasm comprising the marker. For example, "a marker associated with HI" refers to a marker whose presence or absence can be used to predict whether and/or to what extent a plant will display haploid induction.

The term "comprising," which is synonymous with "including," "containing," and "characterized by," is inclusive or open-ended and does not exclude additional, unrecited elements and/or method steps. "Comprising" is a term of art that means that the named elements and/or steps are present, but that other elements and/or steps can be added and still fall within the scope of the relevant subject matter.

As used herein, the phrase "consisting of" excludes any element, step, or ingredient not specifically recited. When the phrase "consists of" appears in a clause of the body of a claim, rather than immediately following the preamble, it limits only the element set forth in that clause; other elements are not excluded from the claim as a whole.

As used herein, the phrase "consisting essentially of" limits the scope of the related disclosure or claim to the specified materials and/or steps, plus those that do not materially affect the basic and novel characteristic(s) of the disclosed and/or claimed subject matter.

With respect to the terms "comprising," "consisting essentially of," and "consisting of," where one of these three terms is used herein, the presently disclosed and claimed subject matter can include in some embodiments the use of either of the other two terms. For example, if a subject matter relates in some embodiments to nucleic acids that encode polypeptides comprising amino acid sequences that are at least 95% identical to a SEQ ID NO:. It is understood that the disclosed subject matter thus also encompasses nucleic acids that encode polypeptides that in some embodiments consist essentially of amino acid sequences that are at least 95% identical to that SEQ ID NO: as well as nucleic acids that encode polypeptides that in some embodiments consist of amino acid sequences that are at least 95% identical to that SEQ ID NO. Similarly, it is also understood that in some embodiments the methods for the disclosed subject matter comprise the steps that are disclosed herein, in some embodiments the methods for the presently disclosed subject matter consist essentially of the steps that are disclosed, and in some embodiments the methods for the presently disclosed subject matter consist of the steps that are disclosed herein.

As used herein, the term "event" refers to a genetically engineered organism or cell, for example, a genetically engineered plant or seed made to have non-natural DNA, which would not normally be found in nature. Events may include transgenic events where a transgene is been inserted into the DNA of an organism. Events may also include the insertion of a particular transgene into a specific location on a chromosome. Events may also include any combination of indels and point mutations.

As used herein, the term "gene" refers to a hereditary unit including a sequence of DNA that occupies a specific location on a chromosome and that contains the genetic instruction for a particular characteristic or trait in an organism.

A "genetic map" is a description of genetic linkage relationships among loci on one or more chromosomes within a given species, generally depicted in a diagrammatic or tabular form.

As used herein a "gene regulatory network" (or "GRN") is a collection of molecular regulators that interact with each other and with other substances in the cell to govern the gene expression levels of mRNA and proteins. The regulator can be DNA, RNA, protein and complexes of these. GRNs may also be inclusive of a "gene family" as used herein. A "gene family" refers to a set of several similar genes, with generally similar biochemical functions.

As used herein, a plant referred to as "haploid" has a reduced number of chromosomes (n) in the haploid plant, and its chromosome set is equal to that of the gamete. In a haploid organism, only half of the normal number of chromosomes are present. Thus haploids of diploid organisms (e.g., maize) exhibit monoploidy; haploids of tetraploid organisms (e.g., ryegrasses) exhibit diploidy; haploids of hexaploid organisms (e.g., wheat) exhibit triploidy; etc. As used herein, a plant referred to as "doubled haploid" is developed by doubling the haploid set of chromosomes. A plant or seed that is obtained from a doubled haploid plant that is selfed to any number of generations may still be identified as a doubled haploid plant. A doubled haploid plant is considered a homozygous plant. A plant is considered to be doubled haploid if it is fertile, even if the entire vegetative part of the plant does not consist of the cells with the doubled set of chromosomes; that is, a plant will be considered doubled haploid if it contains viable gametes, even if it is chimeric in vegetative tissues.

As used herein, the term "human-induced mutation" refers to any mutation that occurs as a result of either direct or indirect human action. This term includes, but is not limited to, mutations obtained by any method of targeted mutagenesis.

As used herein, "introduced" means delivered, expressed, applied, transported, transferred, permeated, or other like term to indicate the delivery, whether of nucleic acid or protein or combination thereof, of a desired object to an object. For example, nucleic acids encoding a site directed nuclease and optionally at least one guide RNA may be introduced into a plant cell.

As used herein, the terms "marker probe" and "probe" refer to a nucleotide sequence or nucleic acid molecule that can be used to detect the presence or absence of a sequence within a larger sequence, e.g., a nucleic acid probe that is complementary to all of or a portion of the marker or marker locus, through nucleic acid hybridization. Marker probes comprising about 8, 10, 15, 20, 30, 40, 50, 60, 70, 80, 90, 100 or more contiguous nucleotides can be used for nucleic acid hybridization.

As used herein, the term "molecular marker" can be used to refer to a genetic marker, as defined above, or an encoded product thereof (e.g., a protein) used as a point of reference when identifying the presence/absence of a HI-associated locus. A molecular marker can be derived from genomic nucleotide sequences or from expressed nucleotide sequences (e.g., from an RNA, a cDNA, etc.). The term also refers to nucleotide sequences complementary to or flanking the marker sequences, such as nucleotide sequences used as probes and/or primers capable of amplifying the marker sequence. Nucleotide sequences are "complementary" when they specifically hybridize in solution (e.g., according to Watson-Crick base pairing rules). This term also refers to the genetic markers that indicate a trait by the absence of the nucleotide sequences complementary to or flanking the marker sequences, such as nucleotide sequences used as probes and/or primers capable of amplifying the marker sequence.

As used herein, the terms "nucleotide sequence," "polynucleotide," "nucleic acid sequence," "nucleic acid molecule," and "nucleic acid fragment" refer to a polymer of RNA or DNA that is single- or double-stranded, optionally containing synthetic, non-natural, and/or altered nucleotide bases. A "nucleotide" is a monomeric unit from which DNA or RNA polymers are constructed and consists of a purine or pyrimidine base, a pentose, and a phosphoric acid group. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

As used herein, the term "nucleotide sequence identity" refers to the presence of identical nucleotides at corresponding positions of two polynucleotides. Polynucleotides have "identical" sequences if the sequence of nucleotides in the two polynucleotides is the same when aligned for maximum correspondence (e.g., in a comparison window). Sequence comparison between two or more polynucleotides is generally performed by comparing portions of the two sequences over a comparison window to identify and compare local regions of sequence similarity. The comparison window is generally from about 20 to 200 contiguous nucleotides. The "percentage of sequence identity" for polynucleotides, such as about 50, 55, 60, 65, 70, 75, 80, 85, 90, 95, 98, 99 or 100 percent sequence identity, can be determined by comparing two optimally aligned sequences over a comparison window, wherein the portion of the polynucleotide sequence in the comparison window can include additions or deletions (i.e., gaps) as compared to the reference sequence for optimal alignment of the two sequences. In some embodiments, the percentage is calculated by: (a) determining the number of positions at which the identical nucleic acid base occurs in both sequences; (b) dividing the number of matched positions by the total number of positions in the window of comparison; and (c) multiplying the result by 100. Optimal alignment of sequences for comparison can also be conducted by computerized implementations of known algorithms, or by visual inspection. Readily available sequence comparison and multiple sequence alignment algorithms are, respectively, the Basic Local Alignment Search Tool (BLAST) and ClustalW/ClustalW2/Clustal Omega programs available on the Internet (e.g., the website of the EMBL-EBI). Other suitable programs include, but are not limited to, GAP, BestFit, Plot Similarity, and FASTA, which are part of the Accelrys GCG Package available from Accelrys, Inc. of San Diego, California, United States of America. See also Smith & Waterman, 1981; Needleman & Wunsch, 1970; Pearson & Lipman, 1988; Ausubel et al., 1988; and Sambrook & Russell, 2001.

One example of an algorithm that is suitable for determining percent sequence identity and sequence similarity is the BLAST algorithm, which is described in Altschul et al., 1990. In some embodiments, a percentage of sequence identity refers to sequence identity over the full length of one of the gDNA, cDNA, or the predicted protein sequences in the largest ORF of SEQ ID No: 1 being compared. In some embodiments, a calculation to determine a percentage of nucleic acid sequence identity does not include in the calculation any nucleotide positions in which either of the compared nucleic acids includes an "N" (i.e., where any nucleotide could be present at that position).

The term "open reading frame" (ORF) refers to a nucleic acid sequence that encodes a polypeptide. In some embodiments, an ORF comprises a translation initiation codon (i.e., start codon), a translation termination (i.e., stop codon), and the nucleic acid sequence there between that encodes the amino acids present in the polypeptide. The terms "initiation codon" and "termination codon" refer to a unit of three adjacent nucleotides (i.e., a codon) in a coding sequence that specifies initiation and chain termination, respectively, of protein synthesis (mRNA translation).

As used herein, the terms "phenotype," "phenotypic trait" or "trait" refer to one or more traits of a plant or plant cell. The phenotype can be observable to the naked eye, or by any other means of evaluation known in the art, e.g., microscopy, biochemical analysis, or an electromechanical assay. In some cases, a phenotype is directly controlled by a single gene or genetic locus (i.e., corresponds to a "single gene trait"). In other cases, a phenotype is the result of interactions among several genes, which in some embodiments also results from an interaction of the plant and/or plant cell with its environment.

As used herein, the term "plant" can refer to a whole plant, any part thereof, or a cell or tissue culture derived from a plant. Thus, the term "plant" can refer to any of: whole plants, plant components or organs (e.g., leaves, stems, roots, etc.), plant tissues, seeds and/or plant cells.

A plant cell is a cell of a plant, taken from a plant, or derived through culture from a cell taken from a plant. Thus, the term "plant cell" includes without limitation cells within seeds, suspension cultures, embryos, meristematic regions, callus tissue, leaves, shoots, gametophytes, sporophytes, pollen, and microspores. The phrase "plant part" refers to a part of a plant, including single cells and cell tissues such as plant cells that are intact in plants, cell clumps, and tissue cultures from which plants can be regenerated. Examples of plant parts include, but are not limited to, single cells and tissues from pollen, ovules, leaves, embryos, roots, root tips, anthers, flowers, fruits, stems, shoots, and seeds; as well as scions, rootstocks, protoplasts, calli, and the like.

As used herein, the term "primer" refers to an oligonucleotide which is capable of annealing to a nucleic acid target (in some embodiments, annealing specifically to a nucleic acid target) allowing a DNA polymerase and/or reverse transcriptase to attach thereto, thereby serving as a point of initiation of DNA synthesis when placed under conditions in which synthesis of a primer extension product is induced (e.g., in the presence of nucleotides and an agent for polymerization such as DNA polymerase and at a suitable temperature and pH). In some embodiments, one or more pluralities of primers are employed to amplify plant nucleic acids (e.g., using the polymerase chain reaction; PCR).

As used herein, the term "probe" refers to a nucleic acid (e.g., a single stranded nucleic acid or a strand of a double stranded or higher order nucleic acid, or a subsequence thereof) that can form a hydrogen-bonded duplex with a complementary sequence in a target nucleic acid sequence. Typically, a probe is of sufficient length to form a stable and sequence-specific duplex molecule with its complement, and as such can be employed in some embodiments to detect a sequence of interest present in a plurality of nucleic acids.

As used herein, the terms "progeny" and "progeny plant" refer to a plant generated from vegetative or sexual reproduction from one or more parent plants. A progeny plant can be obtained by cloning or selfing a single parent plant, or by crossing two or more parental plants. For instance, a progeny plant can be obtained by cloning or selfing of a parent plant or by crossing two parental plants and include selfings as well as the F1 or F2 or still further generations. An F1 is a first-generation progeny produced from parents at least one of which is used for the first time as donor of a trait, while progeny of second generation (F2) or subsequent generations (F3, F4, and the like) are specimens produced from selfings, intercrosses, backcrosses, and/or other crosses of F1s, F2s, and the like. An F1 can thus be (and in some embodiments is) a hybrid resulting from a cross between two true breeding parents (i.e., parents that are true-breeding are each homozygous for a trait of interest or an allele thereof), while an F2 can be (and in some embodiments is) a progeny resulting from self-pollination of the F1 hybrids.

As used herein, the phrase "recombination" refers to an exchange of DNA fragments between two DNA molecules or chromatids of paired chromosomes (a "crossover") over in a region of similar or identical nucleotide sequences. A "recombination event" is herein understood to refer in some embodiments to a meiotic crossover.

As used herein, the term "reference sequence" refers to a defined nucleotide sequence used as a basis for nucleotide sequence comparison.

As used herein, the term "regenerate," and grammatical variants thereof, refers to the production of a plant from tissue culture.

As used herein, the phrase "stringent hybridization conditions" refers to conditions under which a polynucleotide hybridizes to its target subsequence, typically in a complex mixture of nucleic acids, but to essentially no other sequences. Stringent conditions are sequence-dependent and can be different under different circumstances.

Longer sequences typically hybridize specifically at higher temperatures. An extensive guide to the hybridization of nucleic acids is found in Sambrook & Russell, 2001. Generally, stringent conditions are selected to be about 5-10° C. lower than the thermal melting point (Tm) for the specific sequence at a defined ionic strength pH. The Tm is the temperature (under defined ionic strength, pH, and nucleic acid concentration) at which 50% of the probes complementary to the target hybridize to the target sequence at equilibrium (as the target sequences are present in excess, at Tm, 50% of the probes are occupied at equilibrium). Exemplary stringent conditions are those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

Stringent conditions can also be achieved with the addition of destabilizing agents such as formamide. Additional exemplary stringent hybridization conditions include 50% formamide, 5×SSC, and 1% SDS incubating at 42° C.; or SSC, 1% SDS, incubating at 65° C.; with one or more washes in 0.2×SSC and 0.1% SDS at 65° C. For PCR, a temperature of about 36° C. is typical for low stringency amplification, although annealing temperatures can vary between about 32° C. and 48° C. (or higher) depending on primer length. Additional guidelines for determining hybridization parameters are provided in numerous references (see e.g., Ausubel et al., 1999).

As used herein, the term "trait" refers to a phenotype of interest, a gene that contributes to a phenotype of interest, as well as a nucleic acid sequence associated with a gene that contributes to a phenotype of interest. For example, a "HI trait" refers to a haploid induction phenotype as well as a gene (e.g., matI in maize or 0503g27610 in rice) that contributes to a haploid induction and a nucleic acid sequence (e.g., a HI-associated gene product) that is associated with the presence or absence of the haploid induction phenotype.

As used herein, the term "transgene" refers to a nucleic acid molecule introduced into an organism or one or more of its ancestors by some form of artificial transfer technique. The artificial transfer technique thus creates a "transgenic organism" or a "transgenic cell." It is understood that the artificial transfer technique can occur in an ancestor organism (or a cell therein and/or that can develop into the ancestor organism) and yet any progeny individual that has the artificially transferred nucleic acid molecule or a fragment thereof is still considered transgenic even if one or more natural and/or assisted breedings result in the artificially transferred nucleic acid molecule being present in the progeny individual.

As used herein, the term "targeted mutagenesis" or "mutagenesis strategy" refers to any method of mutagenesis that results in the intentional mutagenesis of a chosen gene. Targeted mutagenesis includes the methods CRISPR, TILLING, TALEN, and other methods not yet discovered but which may be used to achieve the same outcome.

It is specifically contemplated that one could mutagenize a promoter to potentially improve the utility of the elements for the expression of transgenes in plants. The mutagenesis of these elements can be carried out at random and the mutagenized promoter sequences screened for activity in a trial-by-error procedure. Alternatively, particular sequences which provide the promoter with desirable expression characteristics, or the promoter with expression enhancement activity, could be identified and these or similar sequences introduced into the promoter via mutation. It is further contemplated that one could mutagenize these sequences in order to enhance their expression of transgenes in a particular species. The means for mutagenizing a DNA segment encoding a promoter sequence of the current invention are well-known to those of skill in the art. As indicated, modifications to promoter or other regulatory element may be made by random, or site-specific mutagenesis procedures. The promoter and other regulatory element may be modified by altering their structure through the addition or deletion of one or more nucleotides from the sequence which encodes the corresponding unmodified sequences.

Mutagenesis may be performed in accordance with any of the techniques known in the art, such as, and not limited to, synthesizing an oligonucleotide having one or more mutations within the sequence of a particular regulatory sequence. In particular, site-specific mutagenesis is a technique useful in the preparation of promoter mutants, through specific mutagenesis of the underlying DNA. RNA-guided endonucleases ("RGEN," e.g., CRISPR/Cas9) may also be used. The technique further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Typically, a primer of about 17 to about 75 nucleotides or more in length is preferred, with about 10 to about 25 or more residues on both sides of the junction of the sequence being altered.

Where a clone comprising a promoter has been isolated in accordance with the instant invention, one may wish to delimit the promoter regions within the clone. One efficient, targeted means for preparing mutagenized promoters relies upon the identification of putative regulatory elements within the promoter sequence. This can be initiated by comparison with promoter sequences known to be expressed in similar tissue specific or developmentally unique patterns. Sequences which are shared among promoters with similar expression patterns are likely candidates for the binding of transcription factors and are thus likely elements which confer expression patterns. Confirmation of these putative regulatory elements can be achieved by deletion analysis of each putative regulatory sequence followed by functional analysis of each deletion construct by assay of a reporter gene which is functionally attached to each construct. As such, once a starting promoter sequence is provided, any of a number of different deletion mutants of the starting promoter could be readily prepared.

The invention disclosed herein provides polynucleotide molecules comprising regulatory element fragments that may be used in constructing novel chimeric regulatory elements. Novel combinations comprising fragments of these polynucleotide molecules and at least one other regulatory element or fragment can be constructed and tested in plants and are considered to be within the scope of this invention. Thus the design, construction, and use of chimeric regulatory elements is one embodiment of this invention. Promoters of the present invention include homologues of cis elements known to affect gene regulation that show homology with the promoter sequences of the present invention.

Functional equivalent fragments of one of the transcription regulating nucleic acids described herein comprise at least 50, 100, 150, 200, 250, 300, 350, 400, 450, 500, 550, 600, 650, 700, 750, 800, 850, 900, 950, or 1000 base pairs of a transcription regulating nucleic acid. Equivalent fragments of transcription regulating nucleic acids, which are obtained by deleting the region encoding the 5'-untranslated region of the mRNA, would then only provide the (untranscribed) promoter region. The 5'-untranslated region can be easily determined by methods known in the art (such as 5'-RACE analysis). Accordingly, some of the transcription regulating nucleic acids, described herein, are equivalent fragments of other sequences.

As indicated above, deletion mutants of the promoter of the invention also could be randomly prepared and then assayed. Following this strategy, a series of constructs are prepared, each containing a different portion of the promoter (a subclone), and these constructs are then screened for activity. A suitable means for screening for activity is to attach a deleted promoter or intron construct which contains a deleted segment to a selectable or screenable marker, and to isolate only those cells expressing the marker gene. In this way, a number of different, deleted promoter constructs are identified which still retain the desired, or even enhanced, activity. The smallest segment which is required for activity is thereby identified through comparison of the selected constructs. This segment may then be used for the construction of vectors for the expression of exogenous genes.

"At least one expression cassette" as described herein refers to, inter alia, DNA including a regulatory sequence and a nucleic acid that encodes a DNA modification enzyme to be expressed by a transfected cell. In one example, the at least one expression cassette is a component of a vector DNA and is expressed after transformation in a transfected cell. The at least one expression cassette as described herein will often include multiple expression cassettes, for example: an expression cassette comprising a regulatory sequence and a nucleic acid encoding a gRNA; an expression cassette comprising a regulatory sequence initiating replication of a Donor DNA; an expression cassette comprising a regulatory sequence and a selectable marker, or some combination thereof, for example an expression cassette comprising DNA encoding a Cas enzyme and a gRNA under the control of an FMOS regulatory sequence. The at least one expression cassette as described herein may comprise further regulatory elements. The term in this context is to be understood in the broad meaning comprising all sequences which may influence construction or function of the at least one expression cassette. Regulatory elements may, for example, modify transcription and/or translation in prokaryotic or eukaryotic organisms. The at least one expression cassette described herein may be downstream (in 3' direction) of the nucleic acid sequence to be expressed and optionally contain additional regulatory elements, such as transcriptional or translational enhancers. Each additional regulatory element may be operably liked to the nucleic acid sequence to be expressed (or the transcription regulating nucleotide sequence). Additional regulatory elements may comprise additional promoters, minimal promoters, promoter elements, or transposon elements which may modify or enhance the expression regulating properties. The at least one expression cassette may also contain one or more introns, one or more exons and one or more terminators.

Furthermore, it is contemplated that promoters combining elements from more than one promoter may be useful. For example, U.S. Pat. No. 5,491,288 discloses combining a Cauliflower Mosaic Virus promoter with a histone promoter. Thus, the elements from the promoters disclosed herein, e.g. FMOS promoters, may be combined with elements from other promoters, FMOS or otherwise, so long as FMOS function is maintained. For example, in certain embodiments introns in FMOS promoters may be replaced with introns from other promoters, such as, an intron from a ubiquitin promoter. Further still FMOS promoters may be lengthened in some embodiments, e.g. by fusing with introns from other promoters, such as, for example, fusing an FMOS promoter with an intron from a ubiquitin promoter.

DETAILED DESCRIPTION OF VARIOUS EMBODIMENTS OF THE INVENTION

The disclosure is directed to, inter alia, systems and methods to improve gene editing efficiencies, for example, to reduce the number of transformations required to generate edits, e.g. new mutations or events in a plant's DNA.

In various embodiments, the disclosure is directed to methods for producing a plurality of unique edits in a plant's T1 seed, e.g. a plurality of unique allele replacements, a plurality of unique base insertions, a plurality of unique base deletions, or a plurality of unique point mutations.

In one exemplary embodiment, a method comprises transforming at least one expression cassette into a plant cell or a plant tissue. FIG. 1 illustrates one example of at least one expression cassette 2 suitable for use in methods of transforming. As depicted herein, cassette 2 is shown as a combination of features in plasmid vector 3, but in other examples expression cassettes can be isolated DNA or can be features within viral vectors. Expression cassette 2 comprises a nucleic acid 4 that encodes a DNA modification enzyme; nucleic acid 6 that encodes at least one guide RNA (gRNA); and floral mosaic (FMOS) regulatory sequence 10, which includes FMOS promoter 10a. In many embodiments, the FMOS regulatory sequence will further include FMOS terminator 10b.

Nucleic acid 4 may encode a variety of DNA modification enzymes. For example, nucleic acid 4 may encode a site-directed nuclease selected from the group consisting of a meganuclease (MN), a zinc-finger nuclease (ZFN), a transcription-activator like effector nuclease (TALEN), a Cas nuclease, a Cas9 nuclease, a Cas12a nuclease (also referred to herein as a Cpf1 nuclease), a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease. SEQ ID NO: 4 is one example of a Cas nuclease, in particular a Cas9a nuclease. SEQ ID NO: 532 is another example of a Cas nuclease, in particular a Cas12a nuclease. Cas nucleases may be modified and still maintain Cas nuclease activity. For example, this Cas12a is a rice codon-optimized version from Lachnospiraceae bacterium ND2006, based on previous publications, except with 3 bp changes to remove 2 Bsp119I and one RsrII sites. Two nuclear localization signals (NLS) are added at its N- and C-terminals respectively; N terminus also contains an epitope tag. Others may desire other changes. Accordingly, in some examples, Cas nucleases will have a sequence that is at least 90%, 95%, 98%, or 99% identical to SEQ ID NO: 4 or SEQ ID NO: 532.

The inclusion of nucleic acid 6 encoding at least one gRNA is optional depending on the nuclease used. For example, when using nucleases, e.g. Cas, which form a nuclease-gRNA complex, it is desirable to use at least one nucleic acid encoding a gRNA. Further, gRNA may be a single strand or can include more than one strand, e.g. a targeter-RNA that hybridizes with a target DNA sequence and an activator-RNA that hybridizes with the targeter-RNA. U.S. Pat. Nos. 8,697,359 and 10,000,772, and United States Patent Publication US20160208243, all of which are incorporated herein by reference, describe various single and multiple guide RNA approaches.

FMOS regulatory sequence 10 mediates expression of the DNA modification enzyme in at least one of a floral primordia cell and a floral reproductive organ, and mediates a plurality of edits in the at least one of the floral primordia and the floral reproductive organ. Floral primordia and floral reproductive organs include structures contained in the fully developed flower as well as the all developmental stages of those structures, as initiated after the transition from vegetative growth to floral development begins. For example, floral primordia and floral reproductive organs include a microsporocyte, an anther, a stamen, a tapetum, megasporocyte, a pistil, an ovary, a style, and a stigma, as well as, any developmental stages of those structures.

Accordingly, the FMOS regulatory sequence may mediate expression in at least one of an inflorescence, a microsporocyte, an anther, a stamen, a tapetum, megasporocyte, a pistil, an ovary, a style, a stigma, or any developmental stages of those structures. In many embodiments, the FMOS regulatory sequence will mediate expression of the DNA modification enzyme in both a male and a female floral reproductive organ or their primordia, and mediates a plurality of edits in both a male and a female floral reproductive organ or their primordia.

It should be clear that FMOS regulatory sequences will mediate significantly more expression of the DNA modification enzyme in the floral primordia and the floral reproductive organ than in vegetative tissues, for example leaves or shoot meristems. The increased rate of expression may vary from embodiment to embodiment. For example, the FMOS regulatory sequence will mediate at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in a shoot apical meristem (SAM). Similar improvements in rates will be seen when comparing expression rates to other vegetative tissues, e.g. leaf tissue.

FMOS regulatory sequences will also mediate significantly more expression of the DNA modification enzyme in the floral primordia and the floral reproductive organ than in a seed. For example, FMOS regulatory sequences will mediate at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 320 least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in a seed.

In some embodiments, the FMOS regulatory sequence mediates expression of the DNA modification enzyme in both a male and a female floral reproductive organ, and mediates a plurality of edits in both a male and a female floral reproductive organ. In such embodiments, the expression of the DNA modification enzyme in the male floral reproductive organ is at least one at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in a shoot apical meristem (SAM). Similarly, the expression of the DNA modification enzyme in the female floral reproductive organ is at least at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in a shoot apical meristem (SAM).

FMOS Expression Test: DNA modification enzyme expression rates may be measured using qRT PCR. For vegetative tissue, we sample the V3 leaf. For seed, we sample mature seed. For floral primordia and the floral reproductive organ, we sample immature tassels and ears (primordia) and four stages of anthers. The stages are as follows: Ear and Tassel Primordia: 1 cm, 2 cm, 4 cm tassels and ears. Anthers: 0.5 mm, 1.0 mm, 1.5 mm, 2.0 mm anthers (pre-meiosis through meiosis).

For expression evaluation using qRT-PCR protocol, RNA is extracted from frozen (leaf, anther, primordia, seed) tissue. gDNA is digested with DNase for 2 hrs. This is used as template in a one-step qRT-PCR in 384 well plates using Sigma and Invitrogen reagents. We use TaqMan assays designed with Primer Express software. Real time qPCR is ran on QuantStudios and Ct (or Cq) values are captured after adjusting baseline and threshold values. Expression values are calculated by normalizing GOI Ct's to an endogenous housekeeping/reference gene Ct for each sample. Assay design will vary with nucleases. For Cas9, for example, primers for qRT-PCR are Forward: TTGTGCTGCTC-CACGAACA (SEQ ID NO:528); Reverse: GCCAGCCAC-TACGAGAAGCT (SEQ ID NO:529), and Probe: CTGCTTCTGCTCGTTGTCCTCCGG (SEQ ID NO: 530). For the PMI assay, primers for qRT-PCR are Forward: CCGGGTGAATCAGCGTTT (SEQ ID NO:649); Reverse: GCCGTGGCCTTTGACAGT (SEQ ID NO: 650), and Probe: TGCCGCCAACGAATCACCGG (SEQ ID NO: 651). For the control gene ZmEF1a assay, primers for qRT-PCR are Forward: GCGCCGTCACCGTATCC (SEQ ID NO: 652); Reverse: GCTCGTCGGGCGTCAGTA (SEQ ID NO: 653); and probe: ATCAGAGGCGAGCAGAAAC-CACACCAC (SEQ ID NO: 654).

In the example shown in FIG. 1, cassette 2 is contained within Vector 24301 (SEQ ID NO: 1). Nucleic acid 4 corresponds to a nucleic acid that encodes Cas9 (SEQ ID NO: 4). Nucleic acid 6 that encodes at least one guide RNA (gRNA) corresponds to a single gRNA comprising the targeter-RNA sequence and the activator-RNA sequence. In this example, the targeter-RNA sequence encodes a sequence that targets a sequence of ADH1 gene. FMOS promoter 10a corresponds to prZmAP1-01, which is a promoter sequence of maize APETALA1 (AP1) gene for specific expression in early and late male and female inflorescences. The sequence includes the upstream promoter, first exon, first intron, and second exon (partial), with 2 bp changes to remove ATG Start codons, thereby making the exons not translatable. In some examples, the FMOS promoter may include at least one of the first native exon modified to remove the start codon, the first intron, and at least a portion of the second exon, wherein the portion of the second exon is not translatable. FMOS terminator 10b corresponds to tZmAP1-01, which is the terminator sequence of maize APETALA1 (AP1) gene. Cassette 2 may be used to create a plurality of edits, e.g. a plurality of indels, including a plurality of single base deletions and larger deletions, as well as single base insertions and larger insertions.

In many embodiments, cassettes may include additional features. For example, cassette 2 includes gRNA promoter 12 to regulate expression of the at least one gRNA. In this example, gRNA promoter 12 corresponds to prOsU3-01, which is the Rice U3 promoter for pol III dependent transcription of non-coding RNAs. Vectors may similarly include additional features such as selectable markers, e.g. marker 14a, which encodes Phosphomannose Isomerase (PMI) and can be used with mannose selection to recover stably transformed plants. Additional features include and regulatory sequences, e.g. promoter 14b and terminator 14c for regulating expression of selectable markers.

Vectors may further include additional features to assist with transformation, e.g. features to assist with *Agrobacterium*-mediated transformation, which is a well-known and useful technique for introducing exogenous nucleic acid molecules into plants. For example, vectors may include portions of the Ti (tumor-inducing) plasmid such as virulence (VIR) genes and T-DNA borders (a left border or LB and a right border or RB). Briefly, the wild type form of *Agrobacterium* contains a Ti (tumor-inducing) plasmid that directs production of tumorigenic crown gall growth on host plants. Transfer of the tumor-inducing T-DNA region of the Ti plasmid to a plant genome utilizes the Ti plasmid-encoded virulence genes as well as T-DNA borders, often referred to as LB and RB, which are a set of direct DNA repeats that delineate the region to be transferred. Vector 1 for example includes RB 18a, LB 18B, VIR gene 18c, and VIR promoter 18d. The portion of the vector between the RB and LB can be considered the at least one expression cassette in many embodiments.

A variety of vectors for use with expression cassettes as described herein are commercially available, for example, from Clontech (Palo Alto, Calif.). Methods of coculturing *Agrobacterium* with cultured plant cells or wounded tissue such as leaf tissue, root explants, hypocotyledons, stem pieces or tubers, for example, also are well known in the art. See, e.g., Glick and Thompson, (eds.), Methods in Plant Molecular Biology and Biotechnology, Boca Raton, Fla.: CRC Press (1993).

Plant cells or tissues may be transformed as desired, e.g. *Agrobacterium*-mediated transformation or biolistic mediated transformation. Biolistic-mediated transformation, first described by Klein et al. (Nature 327:70-73 (1987)), relies on microprojectiles such as gold or tungsten that are coated with the desired nucleic acid molecule by precipitation with calcium chloride, spermidine or polyethylene glycol. The microprojectile particles are accelerated at high speed into an angiosperm tissue using a device such as the BIOLISTIC PD-1000 (Biorad; Hercules Calif.).

Following transformation, the plant cell or plant tissue is regenerated into a T0 plant having a plurality of T1 seed. T1 seed will typically be self-pollinated seed. In some examples, the T0 plant may also be backcrossed to produce "BC1" seed or outcrossed to produce "F1" seed. As used herein, T1 seed is considered to be inclusive of self-pollinated or "selfed" seed, BC1 seed, and F1 seed. The "1" refers to the first generation after the T0 transformation generation. Using embodiments of the invention as disclosed herein the T1 seed (including selfed, BC1, or F1 seed) contain a plurality of unique edits. When using methods of the present disclosure on *Arabidopsis* via floral transformation (e.g. dipping flowers into *agrobacterium* as is known in the art), the subsequently produced plant is considered the T0 plant for purposes of this disclosure. Unique edits may vary from embodiment to embodiment. For example, unique edits may include a plurality of unique allele replacements, a plurality of unique base insertions, and a plurality of unique base deletions. The number of edits may vary, and may include, at least one of at least at least 3, at least 4, at least 5, at least 10, at least 15, at least 20, at least 25, at least 30, at least 35, at least 40, at least 45, at least 50, at least 55, at least 60, and at least 65, at least 70, at least 75, at least 80, at least 85, at least 90 at least 95 unique edits per transformation. Unique edits may be determined by sequence comparison to an unedited sequence.

In some embodiments, methods further include growing the T1 seed to produce a plurality of T1 plants, measuring at least one phenotype in plants of the T1 generation, and selecting a plant of the T1 generation based on the measuring of at least one phenotype, wherein the selected plant has a unique edit. Further, methods may include sequencing the target or insertion site of the edit in the selected plant of the T1 generation, sequencing the target or insertion site of the edit of a non-selected plant of the T1 generation, and aligning the target or insertion sequence of the selected plant with the target or insertion site sequence of the non-selected plant for comparative purposes, for example, to discover which mutations may confer the desired phenotype and which do not.

Methods also include crossing the selected plant of the T1 generation having a unique edit with a plant not having the unique edit to produce a progeny having the unique edit. In some embodiments, the selected plant in the T1 generation can be selfed, e.g. to increase homozygosity.

Figure 2:
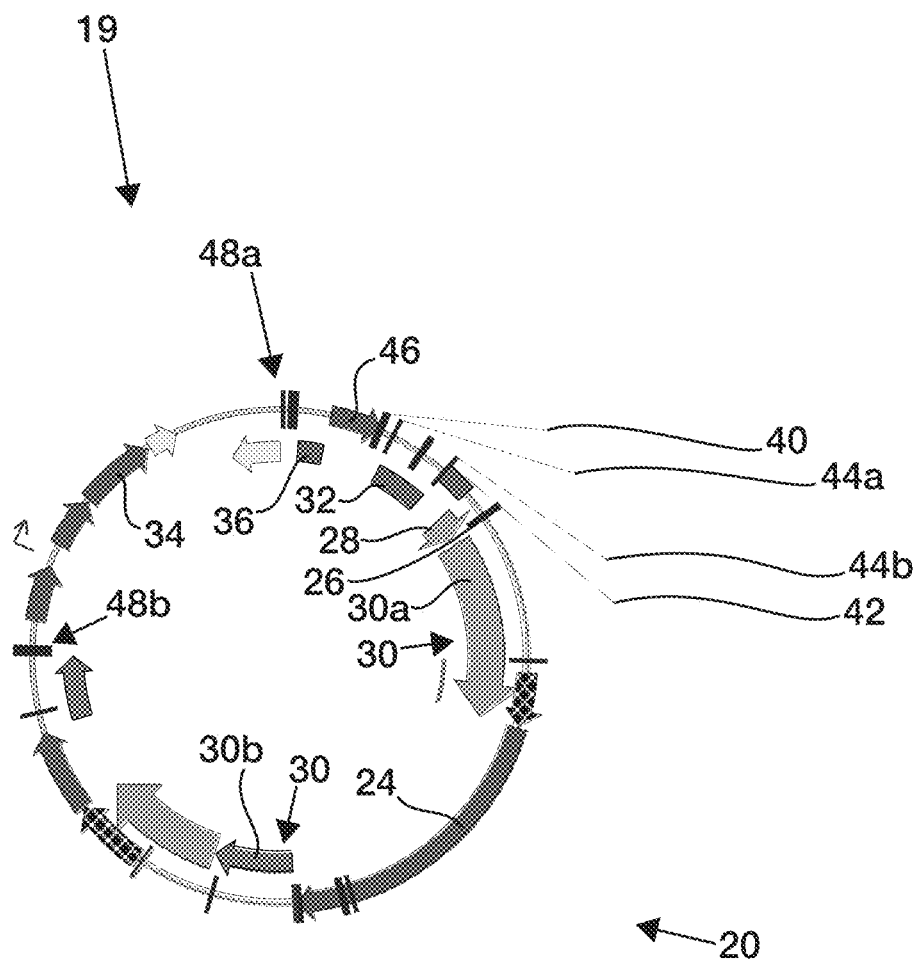
FIG. 2 is an exemplary drawing of a vector used for transformation of maize immature embryos.

FIG. 2 illustrates vector 19 comprising at least one expression cassette 20 suitable for use in methods of transforming to produce a plurality of edits, specifically, a plurality of different allele replacements. Expression cassette 20 comprises a nucleic acid 24 that encodes a DNA modification enzyme; nucleic acid 26 that encodes at least one guide RNA (gRNA); and floral mosaic (FMOS) regulatory sequence 30 including FMOS promoter 30A and FMOS terminator 30B.

In this example, at least one cassette 20 also includes Donor DNA 32 for use in allele replacement and replicase 34 for driving replication of the Donor DNA. Also included is LIR 36 (Long Intergenic Region e.g. derived from Wheat Dwarf Virus (WDV)), SIR 40 (Short Intergenic Region e.g. derived from Wheat Dwarf Virus (WDV), and LIR 42. Replicase 34 initiates rolling circle amplification of Donor DNA 32, which sits between LIR 36 and SIR 40, e.g. where the movement and/or coat protein genes would be in the WDV. Donor Left target sequence 44a and Donor Right target sequence 44b may also be included to help target the Donor DNA to genomic DNA. A fluorescent reporter 44 (cZsGreen) may also be included. Nucleic acid 24 corresponds to a nucleic acid that encodes a site-directed nuclease, e.g. a Cas. Nucleic acid 26 encodes at least one guide RNA (gRNA).

Exemplary FMOS promoters of the FMOS regulatory sequence are shown in Tables 1a. Table 1b lists exemplary FMOS terminators that may also be utilized if desired.

TABLE 1a

| Promoter | SEQ ID NO |
|---|---|
| prZmAP1-01 | SEQ ID NO: 2 |
| prZmBde1-01 | SEQ ID NO: 20 |
| prZmAGO18A-01 | SEQ ID NO: 26 |
| prZmAGO5B-01 | SEQ ID NO: 29 |
| prZmAG5-01 | SEQ ID NO: 35 |
| prZmCoLig-01 | SEQ ID NO: 47 |
| prZmBde1-02 | SEQ ID NO: 50 |
| prOsZFP-01 | SEQ ID NO: 53 |
| prZmAMS-01 | SEQ ID NO: 56 |
| prZmExine1-01 | SEQ ID NO: 62 |
| prOsExine1-01 | SEQ ID NO: 65 |
| prOsTBr1-01 | SEQ ID NO: 71 |
| prOsAP1-01 | SEQ ID NO: 74 |
| prZmRa2-02 | SEQ ID NO: 77 |
| prOsCoLig-001 | SEQ ID NO: 80 |
| prZmWUS2-01 | SEQ ID NO: 83 |
| prZmAGO18B-01 | SEQ ID NO: 86 |
| prGmMADS28-01 | SEQ ID NO: 514 |
| prGmMMD1-01 | SEQ ID NO: 518 |
| modified prZmAP1 | SEQ ID NO: 614 |
| modified prZmBde1 | SEQ ID NO: 615 |
| modified prZmBde1 | SEQ ID NO: 616 |
| modified prZmBde1 | SEQ ID NO: 617 |
| modified prZmBde1 | SEQ ID NO: 618 |
| modified prZmBde1 | SEQ ID NO: 619 |
| modified prOsAP1 | SEQ ID NO: 620 |
| modified prOsAP1 | SEQ ID NO: 621 |
| modified prOsAP1 | SEQ ID NO: 622 |
| prAtAPETALA1-01 | SEQ ID NO: 698 |
| prAtSEPELLATA2-01 | SEQ ID NO: 700 |
| prMMD1-01 | SEQ ID NO: 702 |
| prSlLOXA-01 | SEQ ID NO: 704 |
| prSlTM5-01 | SEQ ID NO: 706 |
| prSlTM29-01 | SEQ ID NO: 708 |
| prGmMMD1-02 | SEQ ID NO: 710 |

TABLE 1a-continued

| Promoter | SEQ ID NO |
|---|---|
| prZmMSCA-01 | SEQ ID NO: 717 |
| prZmPPG4-01 | SEQ ID NO: 719 |
| promoter for NADH dehydrogenase | SEQ ID NO: 721 |
| prZmCID11 | SEQ ID NO: 723 |

TABLE 1b

| Terminator | SEQ ID |
|---|---|
| tZmAP1-01 | SEQ ID NO: 3 |
| tNOS-05-01 | SEQ ID NO: 21 |
| tZmBde1-01 | SEQ ID NO: 24 |
| tZmAGO18A-01 | SEQ ID NO: 27 |
| tZmAGO5B-01 | SEQ ID NO: 30 |
| tZmAG5-01 | SEQ ID NO: 36 |
| tZmCoLig-01 | SEQ ID NO: 48 |
| tZmBde1-01 | SEQ ID NO: 51 |
| tOsZFP-01 | SEQ ID NO: 54 |
| tZmAMS-01 | SEQ ID NO: 57 |
| tZmExine1-01 | SEQ ID NO: 63 |
| tOsExine1-01 | SEQ ID NO: 66 |
| tOsTBr1-01 | SEQ ID NO: 72 |
| tOsAP1-01 | SEQ ID NO: 75 |
| trZmRa2-02 | SEQ ID NO: 78 |
| tOsCoLig-01 | SEQ ID NO: 81 |
| tZmWUS2-01 | SEQ ID NO: 84 |
| tZmAGO18B-01 | SEQ ID NO: 87 |
| tGmMADS29-01 | SEQ ID NO: 515 |
| tGmMMD1-01 | SEQ ID NO: 519 |
| tAtAPETALA1-01 | SEQ ID NO: 699 |
| tAtSEPELLATA2-01 | SEQ ID NO: 701 |
| tMMD1-01 | SEQ ID NO: 703 |
| tSlLOXA-01 | SEQ ID NO: 705 |
| tSlTM5-01 | SEQ ID NO: 707 |
| tSlTM29-01 | SEQ ID NO: 709 |
| tZmMSCA1-01 | SEQ ID NO: 718 |
| tZmPPG4-01 | SEQ ID NO: 720 |
| terminator for NADH dehydrogenase | SEQ ID NO: 722 |
| tZmCID11 | SEQ ID NO: 724 |

Further, those of ordinary skill in the art will be able to modify the FMOS sequences disclosed in Tables 1a and 1b to practice the inventions as illustrated in Table 1c and Table 1d below. For example, transcription factor (TF) binding motifs can be removed or modified to achieve or improve performance of an FMOS regulatory sequence. When modifying promoters, applicants typically keep important TF binding motifs, which are those related to flowering. For example, applicants prefer to keep TF binding motif AC: RSP02530//OS: rice (Oryza sativa, japonica)/GENE: DEP1/RE: GTAC-motif 3/BF: IPA1 (DEP1 is a flowering TF).

Figure 34:
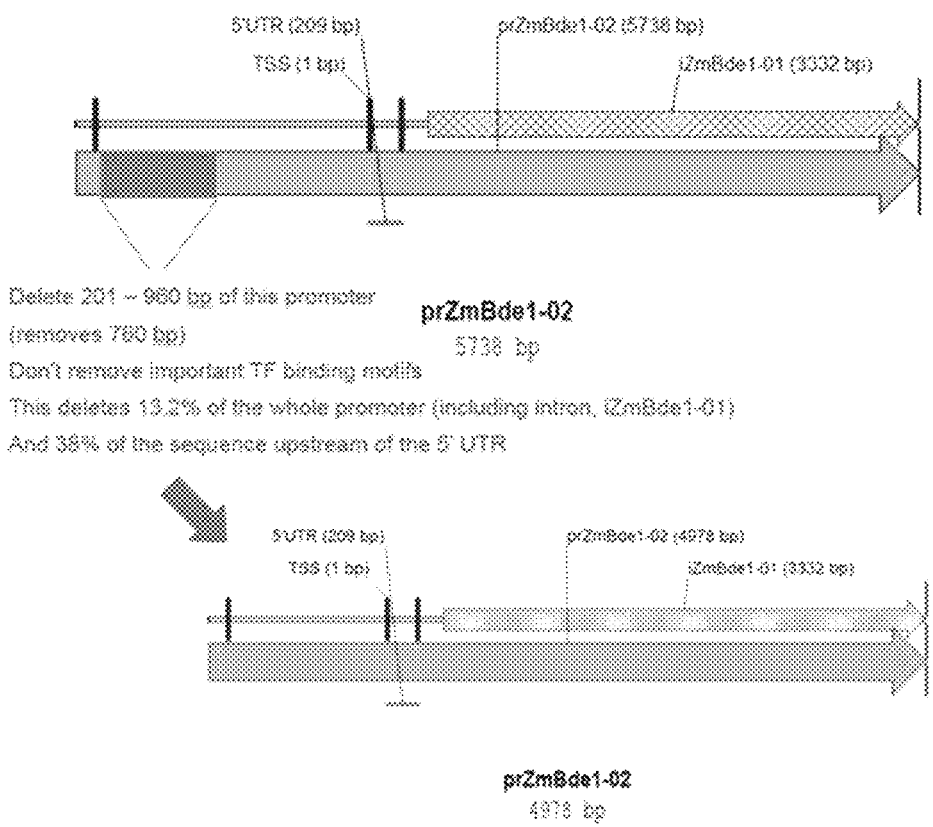
FIG. 34 is a schematic drawing illustrating modification of prZmBde1.

FIG. 34 illustrates, by way of example, prZmBde1-02 (SEQ ID NO: 50, e.g. in vector 24320) which has been modified to remove 760 bp (38% of the promoter sequence upstream of the 5'UTR). In other examples, FMOS efficacy was maintained with even more modification to the FMOS promoter. For example, prOsAP1-01 (SEQ ID NO: 74) maintained efficacy even after 53% of the sequence was removed. Some may also desire to fuse promoters or terminators, e.g. create a fusion of a Bde1 sequence with a with AP1 sequence, e.g. by intron replacement, and have similar FMOS performance. In some examples, FMOS performance may be improved by replacing a native FMOS promoter intron with an intron from another promoter, for example, from a ubiquitin promoter. By way of example, the intron, or a portion thereof, in prBde1-02 (as in vector 24320), may be replaced by an intron, or portion thereof from a ubiquitin promoter, e.g. iUbi1-07 (e.g. at least 50% of, at least 60% of, at least 70% of, at least 80% of, at least 90% of at least 95% of, at least 99% of or all of SEQ ID NO: 531). Further, in some example an FMOS performance may be improved by fusing a native FMOS promoter with the intron from a ubiquitin promoter. For example, promoter prBde1-02 (as in vector 24320), may be fused with a ubiquitin promoter, e.g. iUbi1-07 (e.g. at least 50% of, at least 60% of, at least 70% of, at least 80% of, at least 90% of at least 95% of, at least 99% of or all of SEQ ID NO: 531)

TABLE 1c

| Promoter | SEQ ID NO |
|---|---|
| prZmAP1-01 | At least 60%, at least 65%, at least 70%, at least 75%, at least 80%, at least 85%, at least 90%, and at least 95% homology to SEQ ID NO: 2 |
| prZmBde1-01 | At least 60%, at least 65%, at least 70%, at least 75%, at least 80%, at least 85%, at least 90%, and at least 95% homology to SEQ ID NO: 20 |
| prZmAGO18A-01 | At least 60%, at least 65%, at least 70%, at least 75%, at least 80%, at least 85%, at least 90%, and at least 95% homology to SEQ ID NO: 26 |
| prZmAGO5B-01 | At least 60%, at least 65%, at least 70%, at least 75%, at least 80%, at least 85%, at least 90%, and at least 95% homology to SEQ ID NO: 29 |
| prZmAG5-01 | At least 60%, at least 65%, at least 70%, at least 75%, at least 80%, at least 85%, at least 90%, and at least 95% homology to SEQ ID NO: 35 |
| prZmCoLig-01 | At least 60%, at least 65%, at least 70%, at least 75%, at least 80%, at least 85%, at least 90%, and at least 95% homology to SEQ ID NO: 47 |
| prZmBde1-02 | At least 60%, at least 65%, at least 70%, at least 75%, at least 80%, at least 85%, at least 90%, and at least 95% homology to SEQ ID NO: 50 |
| prOsZFP-01 | At least 60%, at least 65%, at least 70%, at least 75%, at least 80%, at least 85%, at least 90%, and at least 95% homology to SEQ ID NO: 53 |
| prZmAMS-01 | At least 60%, at least 65%, at least 70%, at least 75%, at least 80%, at least 85%, at least 90%, and at least 95% homology to SEQ ID NO: 56 |
| prZmExine1-01 | At least 60%, at least 65%, at least 70%, at least 75%, at least 80%, at least 85%, at least 90%, and at least 95% homology to SEQ ID NO: 62 |
| prOsExine1-01 | At least 60%, at least 65%, at least 70%, at least 75%, at least 80%, at least 85%, at least 90%, and at least 95% homology to SEQ ID NO: 65 |
| prOsTBr1-01 | At least 60%, at least 65%, at least 70%, at least 75%, at least 80%, at least 85%, at least 90%, and at least 95% homology to SEQ ID NO: 71 |
| prOsAP1-01 | At least 60%, at least 65%, at least 70%, at least 75%, at least 80%, at least 85%, at least 90%, and at least 95% homology to SEQ ID NO: 74 |
| prZmRa2-02 | At least 60%, at least 65%, at least 70%, at least 75%, at least 80%, at least 85%, at least 90%, and at least 95% homology to SEQ ID NO: 77 |
| prOsCoLig-01 | At least 60%, at least 65%, at least 70%, at least 75%, at least 80%, at least 85%, at least 90%, and at least 95% homology to SEQ ID NO: 80 |
| prZmWUS2-01 | At least 60%, at least 65%, at least 70%, at least 75%, at least 80%, at least 85%, at least 90%, and at least 95% homology to SEQ ID NO: 83 |
| prZmAGO18B-01 | At least 60%, at least 65%, at least 70%, at least 75%, at least 80%, at least 85%, at least 90%, and at least 95% homology to SEQ ID NO: 86 |
| prGmMADS28-01 | At least 60%, at least 65%, at least 70%, at least 75%, at least 80%, at least 85%, at least 90%, and at least 95% homology to SEQ ID NO: 514 |
| prGmMMD1-01 | At least 60%, at least 65%, at least 70%, at least 75%, at least 80%, at least 85%, at least 90%, and at least 95% homology to SEQ ID NO: 518 |
| prAtAPETALA1-01 | At least 60%, at least 65%, at least 70%, at least 75%, at least 80%, at least 85%, at least 90%, and at least 95% homology to SEQ ID NO: 698 |
| prAtSEPELLATA2-01 | At least 60%, at least 65%, at least 70%, at least 75%, at least 80%, at least 85%, at least 90%, and at least 95% homology to SEQ ID NO: 700 |
| prMMD1-01 | At least 60%, at least 65%, at least 70%, at least 75%, at least 80%, at least 85%, at least 90%, and at least 95% homology to SEQ ID NO: 702 |
| prSlLOXA-01 | At least 60%, at least 65%, at least 70%, at least 75%, at least 80%, at least 85%, at least 90%, and at least 95% homology to SEQ ID NO: 704 |
| prSlTM5-01 | At least 60%, at least 65%, at least 70%, at least 75%, at least 80%, at least 85%, at least 90%, and at least 95% homology to SEQ ID NO: 706 |
| prSlTM29-01 | At least 60%, at least 65%, at least 70%, at least 75%, at least 80%, at least 85%, at least 90%, and at least 95% homology to SEQ ID NO: 708 |

TABLE 1c-continued

| Promoter | SEQ ID NO |
|---|---|
| prGmMMD1-02 | At least 60%, at least 65%, at least 70%, at least 75%, at least 80%, at least 85%, at least 90%, and at least 95% homology to SEQ ID NO: 710 |
| prZmMSCA1-01 | At least 60%, at least 65%, at least 70%, at least 75%, at least 80%, at least 85%, at least 90%, and at least 95% homology to SEQ ID NO: 717 |
| prZmPPG4-01 | At least 60%, at least 65%, at least 70%, at least 75%, at least 80%, at least 85%, at least 90%, and at least 95% homology to SEQ ID NO: 719 |
| promoter for NADH dehydrogenase | At least 60%, at least 65%, at least 70%, at least 75%, at least 80%, at least 85%, at least 90%, and at least 95% homology to SEQ ID NO: 721 |
| prZmCID11 | At least 60%, at least 65%, at least 70%, at least 75%, at least 80%, at least 85%, at least 90%, and at least 95% homology to SEQ ID NO: 723 |

TABLE 1d

| Terminator | SEQ ID |
|---|---|
| tZmAP1-01 | At least 60%, at least 65%, at least 70%, at least 75%, at least 80%, at least 85%, at least 90%, and at least 95% homology to SEQ ID NO: 3 |
| tNOS-05-01 | At least 60%, at least 65%, at least 70%, at least 75%, at least 80%, at least 85%, at least 90%, and at least 95% homology to SEQ ID NO: 21 |
| tZmBde1-01 | At least 60%, at least 65%, at least 70%, at least 75%, at least 80%, at least 85%, at least 90%, and at least 95% homology to SEQ ID NO: 24 |
| tZmAGO18A-01 | At least 60%, at least 65%, at least 70%, at least 75%, at least 80%, at least 85%, at least 90%, and at least 95% homology to SEQ ID NO: 27 |
| tZmAGO5B-01 | At least 60%, at least 65%, at least 70%, at least 75%, at least 80%, at least 85%, at least 90%, and at least 95% homology to SEQ ID NO: 30 |
| tZmAG5-01 | At least 60%, at least 65%, at least 70%, at least 75%, at least 80%, at least 85%, at least 90%, and at least 95% homology to SEQ ID NO: 36 |
| tZmCoLig-01 | At least 60%, at least 65%, at least 70%, at least 75%, at least 80%, at least 85%, at least 90%, and at least 95% homology to SEQ ID NO: 48 |
| tZmBde1-01 | At least 60%, at least 65%, at least 70%, at least 75%, at least 80%, at least 85%, at least 90%, and at least 95% homology to SEQ ID NO: 51 |
| tOsZFP-01 | At least 60%, at least 65%, at least 70%, at least 75%, at least 80%, at least 85%, at least 90%, and at least 95% homology to SEQ ID NO: 54 |
| tZmAMS-01 | At least 60%, at least 65%, at least 70%, at least 75%, at least 80%, at least 85%, at least 90%, and at least 95% homology to SEQ ID NO: 57 |
| tZmExine1-01 | At least 60%, at least 65%, at least 70%, at least 75%, at least 80%, at least 85%, at least 90%, and at least 95% homology to SEQ ID NO: 63 |
| tOsExine1-01 | At least 60%, at least 65%, at least 70%, at least 75%, at least 80%, at least 85%, at least 90%, and at least 95% homology to SEQ ID NO: 66 |
| tOsTBr1-01 | At least 60%, at least 65%, at least 70%, at least 75%, at least 80%, at least 85%, at least 90%, and at least 95% homology to SEQ ID NO: 72 |
| tOsAP1-01 | At least 60%, at least 65%, at least 70%, at least 75%, at least 80%, at least 85%, at least 90%, and at least 95% homology to SEQ ID NO: 75 |
| trZmRa2-02 | At least 60%, at least 65%, at least 70%, at least 75%, at least 80%, at least 85%, at least 90%, and at least 95% homology to SEQ ID NO: 78 |
| tOsCoLig-01 | At least 60%, at least 65%, at least 70%, at least 75%, at least 80%, at least 85%, at least 90%, and at least 95% homology to SEQ ID NO: 81 |
| tZmWUS2-01 | At least 60%, at least 65%, at least 70%, at least 75%, at least 80%, at least 85%, at least 90%, and at least 95% homology to SEQ ID NO: 84 |
| tZmAGO18B-01 | At least 60%, at least 65%, at least 70%, at least 75%, at least 80%, at least 85%, at least 90%, and at least 95% homology to SEQ ID NO: 87 |
| tGmMADS29-01 | At least 60%, at least 65%, at least 70%, at least 75%, at least 80%, at least 85%, at least 90%, and at least 95% homology to SEQ ID NO: 515 |

TABLE 1d-continued

| Terminator | SEQ ID |
|---|---|
| tGmMMD1-01 | At least 60%, at least 65%, at least 70%, at least 75%, at least 80%, at least 85%, at least 90%, and at least 95% homology to SEQ ID NO: 519 |
| tAtAPETALA1-01 | At least 60%, at least 65%, at least 70%, at least 75%, at least 80%, at least 85%, at least 90%, and at least 95% homology to SEQ ID NO: 699 |
| tAtSEPELLATA2-01 | At least 60%, at least 65%, at least 70%, at least 75%, at least 80%, at least 85%, at least 90%, and at least 95% homology to SEQ ID NO: 701 |
| tMMD1-01 | At least 60%, at least 65%, at least 70%, at least 75%, at least 80%, at least 85%, at least 90%, and at least 95% homology to SEQ ID NO: 703 |
| tSlLOXA-01 | At least 60%, at least 65%, at least 70%, at least 75%, at least 80%, at least 85%, at least 90%, and at least 95% homology to SEQ ID NO: 705 |
| tSlTM5-01 | At least 60%, at least 65%, at least 70%, at least 75%, at least 80%, at least 85%, at least 90%, and at least 95% homology to SEQ ID NO: 707 |
| tSlTM29-01 | At least 60%, at least 65%, at least 70%, at least 75%, at least 80%, at least 85%, at least 90%, and at least 95% homology to SEQ ID NO: 709 |
| tZmMSCA1-01 | At least 60%, at least 65%, at least 70%, at least 75%, at least 80%, at least 85%, at least 90%, and at least 95% homology to SEQ ID NO: 718 |
| tZmPPG4-01 | At least 60%, at least 65%, at least 70%, at least 75%, at least 80%, at least 85%, at least 90%, and at least 95% homology to SEQ ID NO: 720 |
| terminator for NADH dehydrogenase | At least 60%, at least 65%, at least 70%, at least 75%, at least 80%, at least 85%, at least 90%, and at least 95% homology to SEQ ID NO: 722 |
| tZmCID11 | At least 60%, at least 65%, at least 70%, at least 75%, at least 80%, at least 85%, at least 90%, and at least 95% homology to SEQ ID NO: 724 |

The FMOS sequences listed in Tables 1a, 1b, 1c, and 1d are intended to be exemplary only, as one of ordinary skill in the art will be readily able to construct expression cassettes as described herein by identifying and screening candidate regulatory sequences, e.g. promoters and terminators, for FMOS activity. Screening will similarly help distinguish non-FMOS regulatory sequences, which may not meet FMOS criteria, for instance, they may not express the editing machinery strongly enough to see sufficient edits or they may act like constitutive promoter when used in heterologous cassettes to drive transgene expression. Alternatively, non-FMOS sequences may fail because they are 'leaky' and lead to significant expression of the editing transgene in unwanted places—such as non-floral tissues (e.g. callus or vegetative meristem). Methods for validating FMOS regulatory sequences are provided in the Examples below.

Exemplary Embodiments

1. A method for producing a plurality of unique edits in a plant's T1 seed, the method comprising:
    a) transforming at least one expression cassette into a plant cell or a plant tissue, wherein the at least one expression cassette comprises
        a nucleic acid that encodes a DNA modification enzyme,
        optionally, a nucleic acid that encodes at least one guide RNA (gRNA), and
        a floral mosaic (FMOS) regulatory sequence, wherein the FMOS regulatory sequence
            (i) mediates expression of the DNA modification enzyme in at least one of a floral primordia cell and a floral reproductive organ, and
            (ii) mediates a plurality of edits in the at least one of the floral primordia and the floral reproductive organ; and
    b) regenerating the plant cell or plant tissue into a T0 plant having a plurality of T1 seed, wherein the T1 seed contain a plurality of unique edits.

2. The method of 1, wherein the plurality of unique edits are selected from the group consisting of a plurality of unique allele replacements, a plurality of unique base insertions, and a plurality of unique base deletions.

3. The method of 1 or 2, wherein the DNA modification enzyme is a site-directed nuclease selected from the group consisting of a meganuclease (MN), a zinc-finger nuclease (ZFN), a transcription-activator like effector nuclease (TALEN), a Cas nuclease, a Cas9 nuclease, a Cpf1 nuclease, a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease.

4. The method of any of the above, wherein
    the DNA modification enzyme is a Cas9 nuclease or a Cpf1 nuclease, and
    the at least one expression cassette comprises the nucleic acid that encodes a gRNA, wherein the nucleic acid that encodes a gRNA is operably linked to the FMOS promoter or a second promoter.

5. The method of any of the above, wherein
    the unique edit is an allele replacement, and
    the at least one expression cassette further comprises a nucleic acid of interest (Donor DNA).

6. The method of any of 5, wherein the at least one expression cassette further comprises a replication promoter operably linked to the Donor DNA to drive replication of the Donor DNA.

7. The method of 5 or 6, wherein the at least one expression cassette further comprises at least one LIR.

8. The method of any of the above, further comprising
   growing the T1 seed to produce a plurality of T1 plants, and
   measuring at least one phenotype in plants of the T1 generation, and
   selecting a plant of the T1 generation based on the measuring of at least one phenotype, wherein the selected plant has a unique edit.
9. The method of 8, further comprising
   sequencing the insertion site of the Donor DNA in the selected plant of the T1 generation,
   sequencing the insertion site of the Donor DNA of a non-selected plant of the T1 generation, and
   aligning the insertion site sequence of the selected plant with the insertion site sequence of the non-selected plant.
10. The method of 8 or 9, further comprising crossing the selected plant of the T1 generation having a unique edit with a plant not having the unique edit to produce a progeny having the unique edit.
11. The method of claim any of the above, wherein the FMOS regulatory sequence mediates expression in at least one of an inflorescence, a microsporocyte, an anther, a stamen, a tapetum, megasporocyte, a pistil, an ovary, a style, and a stigma.
12. The method of any of the above, wherein the FMOS regulatory sequence mediates
   at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in vegetative tissue, and
   at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in a seed.
13. The method of any of the above, wherein the FMOS regulatory sequence comprises an FMOS promotor and an FMOS terminator.
14. The method of any of the above, wherein the FMOS promoter is selected from the group consisting of SEQ ID NO: 2, SEQ ID NO: 20, SEQ ID NO: 26, SEQ ID NO: 29, SEQ ID NO: 35, SEQ ID NO: 47, SEQ ID NO: 50, SEQ ID NO: 53, SEQ ID NO: 56, SEQ ID NO: 62, SEQ ID NO: 65, SEQ ID NO: 71, SEQ ID NO: 74, SEQ ID NO: 77, SEQ ID NO: 80, SEQ ID NO: 83, SEQ ID NO: 86, SEQ ID NO: 514, SEQ ID NO: 518, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 698, SEQ ID NO: 700, SEQ ID NO: 702, SEQ ID NO: 704, SEQ ID NO: 706, SEQ ID NO: 708, SEQ ID NO: 710, SEQ ID NO: 717, SEQ ID NO: 719, SEQ ID NO: 721, and SEQ ID NO: 723 or a sequence with at least one of at least 60%, at least 65%, at least 70%, at least 75%, at least 80%, at least 90% homology thereto.
15. The method of any of the above, wherein the FMOS terminator is selected from the group consisting of at least one of SEQ ID NO: 3, SEQ ID NO: 21, SEQ ID NO: 24, SEQ ID NO: 27, SEQ ID NO: 30, SEQ ID NO: 36, SEQ ID NO: 48, SEQ ID NO: 51, SEQ ID NO: 54, SEQ ID NO: 57, SEQ ID NO: 63, SEQ ID NO: 66, SEQ ID NO: 72, SEQ ID NO: 75, SEQ ID NO: 78, SEQ ID NO: 81, SEQ ID NO: 84, SEQ ID NO: 87, SEQ ID NO: 515, SEQ ID NO: 519, SEQ ID NO: 699, SEQ ID NO: 701, SEQ ID NO: 703, SEQ ID NO: 705, SEQ ID NO: 707, SEQ ID NO: 709, SEQ ID NO: 718, SEQ ID NO: 720, SEQ ID NO: 722, and SEQ ID NO: 724 or a sequence with at least one of at least 60%, at least 65%, at least 70%, at least 75%, at least 80%, at least 90% homology thereto.
16. The method of any of the above, wherein the plurality of unique edits includes at least one of: at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique edits.
17. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.

18. The method of any of the above, wherein FMOS regulatory sequence
    (i) mediates expression of the DNA modification enzyme in both a male and a female floral reproductive organ, and
    (ii) mediates a plurality of edits in both a male and a female floral reproductive organ.
19. The method of any of the above, wherein
    the expression of the DNA modification enzyme in the male floral reproductive organ is at least one at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in vegetative tissue, and
    the expression of the DNA modification enzyme in the female floral reproductive organ is at least at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in vegetative tissue.
20. The method of any of the above, further comprising measuring the number of edits in at least one of the T0 flower, T0 tassel, and seed of the T0 plant.
21. A method for producing a plurality of unique edits in a plant's T1 seed, the method comprising:
    a) transforming at least one expression cassette into a plant cell or a plant tissue, wherein the at least one expression cassette comprises
        a nucleic acid that encodes a DNA modification enzyme selected from the group consisting of a Cas9 nuclease and a Cpf1 nuclease,
        a nucleic acid that encodes a guide RNA (gRNA), and
        a floral mosaic (FMOS) regulatory sequence comprising an FMOS promoter, wherein the FMOS regulatory sequence
            (i) mediates expression of the DNA modification enzyme in at least one of a floral primordia cell and a floral reproductive organ,
            (ii) mediates a plurality of edits in the at least one of the floral primordia and the floral reproductive organ,
            (iii) mediates at least one of at least two-fold more expression, at least three-fold more expression, at least four fold-more expression, at least 5-fold more expression and at least six-fold more expression of the DNA modification enzyme in the at least one of the floral primordia and the floral reproductive organ than in a shoot apical meristem (SAM), and
            (iv) mediates at least one of at least two-fold more expression, at least three-fold more expression, at least four fold-more expression, at least 5-fold more expression and at least six-fold more expression of the DNA modification enzyme in the at least one of the floral primordia and the floral reproductive organ than in a seed;
    b) regenerating the plant cell or plant tissue into a plant having a plurality of T1 seed; and
    c) growing the T1 seed to produce a T1 generation, wherein the T1 generation contains at least one of at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique edits.
22. The method of 21, further comprising
    d) measuring at least one phenotype in plants of the T1 generation,
    e) selecting a plant of the T1 generation based on the measuring of at least one phenotype, wherein the selected plant has a unique edit, and
    f) sequencing the insertion site of the Donor DNA in the selected plant of the T1 generation.
23. The method of 21 or 22, wherein FMOS promoter is selected from the group consisting of SEQ ID NO: 2, SEQ ID NO: 20, SEQ ID NO: 26, SEQ ID NO: 29, SEQ ID NO: 35, SEQ ID NO: 47, SEQ ID NO: 50, SEQ ID NO: 53, SEQ ID NO: 56, SEQ ID NO: 62, SEQ ID NO: 65, SEQ ID NO: 71, SEQ ID NO: 74, SEQ ID NO: 77, SEQ ID NO: 80, SEQ ID NO: 83, SEQ ID NO: 86, SEQ ID NO: 514, SEQ ID NO: 518, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 698, SEQ ID NO: 700, SEQ ID NO: 702, SEQ ID NO: 704, SEQ ID NO: 706, SEQ ID NO: 708, SEQ ID NO: 710, SEQ ID NO: 717, SEQ ID NO: 719, SEQ ID NO: 721, and SEQ ID NO: 723 or a sequence with at least one of at least 60%, at least 65%, at least 70%, at least 75%, at least 80%, at least 90% homology thereto.

24. A method for producing a plurality of unique edits in a plant's T1 seed, the method comprising:
a) expressing, in a plant cell or a plant tissue selected from the group consisting of a floral primordia cell and a floral reproductive organ,
   a nucleic acid that encodes a DNA modification enzyme, and
   a nucleic acid that encodes a guide RNA (gRNA),
wherein at least one of the nucleic acid that encodes a DNA modification enzyme and the nucleic acid that encodes a gRNA is operably linked to a floral mosaic (FMOS) regulatory sequence, wherein the FMOS regulatory sequence
(i) mediates expression of at least one of the DNA modification enzyme and the gRNA in at least one of a floral primordia cell and a floral reproductive organ, and
(ii) mediates a plurality of edits in the at least one of the floral primordia and the floral reproductive organ; and
b) regenerating the plant cell or plant tissue into a plant having a plurality of T1 seed, wherein the T1 seed contain a plurality of unique edits.

25. The method of 24, further comprising
delivering a nucleic acid of interest (Donor DNA) to the plant cell or the plant tissue where the expressing is performed, and
inserting the Donor DNA into the genome of the plant.

26. The method of 24 or 25, wherein the FMOS regulatory sequence comprises at least one of an FMOS promotor and an FMOS terminator, wherein
the FMOS promoter is selected from the group consisting of SEQ ID NO: 2, SEQ ID NO: 20, SEQ ID NO: 26, SEQ ID NO: 29, SEQ ID NO: 35, SEQ ID NO: 47, SEQ ID NO: 50, SEQ ID NO: 53, SEQ ID NO: 56, SEQ ID NO: 62, SEQ ID NO: 65, SEQ ID NO: 71, SEQ ID NO: 74, SEQ ID NO: 77, SEQ ID NO: 80, SEQ ID NO: 83, SEQ ID NO: 86, SEQ ID NO: 514, SEQ ID NO: 518, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 698, SEQ ID NO: 700, SEQ ID NO: 702, SEQ ID NO: 704, SEQ ID NO: 706, SEQ ID NO: 708, SEQ ID NO: 710, SEQ ID NO: 717, SEQ ID NO: 719, SEQ ID NO: 721, and SEQ ID NO: 723 or a sequence with at least one of at least 60%, at least 65%, at least 70%, at least 75%, at least 80%, at least 90% homology thereto, and
the FMOS terminator is selected from the group consisting of at least one of SEQ ID NO: 3, SEQ ID NO: 21, SEQ ID NO: 24, SEQ ID NO: 27, SEQ ID NO: 30, SEQ ID NO: 36, SEQ ID NO: 48, SEQ ID NO: 51, SEQ ID NO: 54, SEQ ID NO: 57, SEQ ID NO: 63, SEQ ID NO: 66, SEQ ID NO: 72, SEQ ID NO: 75, SEQ ID NO: 78, SEQ ID NO: 81, SEQ ID NO: 84, SEQ ID NO: 87, SEQ ID NO: 515, SEQ ID NO: 519, SEQ ID NO: 699, SEQ ID NO: 701, SEQ ID NO: 703, SEQ ID NO: 705, SEQ ID NO: 707, SEQ ID NO: 709, SEQ ID NO: 718, SEQ ID NO: 720, SEQ ID NO: 722, and SEQ ID NO: 724 or a sequence with at least one of at least 60%, at least 65%, at least 70%, at least 75%, at least 80%, at least 90% homology thereto.

27. The method of any of the above, wherein the T0 plant has a mosaicism score of at least 0.5, 1, 1.5, 2, 3, 4, 5, 6, 7, 8, 9, 10, 11, 12, 13, 14, 15, 16 17, 18, 19, and 20, wherein the mosaicism score is determined by Mosaicism Score Methodology 1. The upper limit of the mosaicism score will be determined by the efficacy of the FMOS promoter, however, applicant expects typical mosaicism scores to be in the range of at least one of 0.5 to 30, 1 to 25, 2 to 25, 3 to 25, 4 to 25, 5 to 25, 6 to 25, 5 to 20, 5 to 19, 5 to 18, 5 to 17, 5 to 16, and 5 to 15.

28. At least one expression cassette for producing at least 20 unique edits in a plant's T1 seed, the expression cassette comprising:
a nucleic acid that encodes a DNA modification enzyme,
optionally, a nucleic acid that encodes at least one guide RNA (gRNA), and
a floral mosaic (FMOS) promoter, wherein the FMOS promoter
(i) mediates expression of the DNA modification enzyme in at least one of a floral primordia cell and a floral reproductive organ, and
(ii) mediates a plurality of edits in the at least one of the floral primordia and the floral reproductive organ, and
(iii) mediates
at least one at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more expression of the DNA modification enzyme in the at least one of the floral primordia and the floral reproductive organ than in a vegetative tissue, and
at least one at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more more expression of the DNA modification enzyme in the at least one of the floral primordia and the floral reproductive organ than in a seed.

29. The cassette of 28, wherein
the DNA modification enzyme is a Cas9 nuclease or a Cpf1 nuclease;
the cassette comprises the nucleic acid that encodes a gRNA, wherein the nucleic acid that encodes a gRNA is operably linked to the FMOS promoter or a second promoter;
the cassette further comprises a nucleic acid of interest (Donor DNA) and a replication promoter operably linked to the Donor DNA to drive replication of the Donor DNA; and
the FMOS promoter mediates expression in at least one of an inflorescence, a microsporocyte, an anther, a stamen, a tapetum, megasporocyte, a pistil, an ovary, a style, and a stigma.

29. The cassette of 27 or 28, wherein the FMOS promoter is selected from the group consisting of SEQ ID NO: 2, SEQ ID NO: 20, SEQ ID NO: 26, SEQ ID NO: 29, SEQ ID NO: 35, SEQ ID NO: 47, SEQ ID NO: 50, SEQ ID NO: 53, SEQ ID NO: 56, SEQ ID NO: 62, SEQ ID NO: 65, SEQ ID NO: 71, SEQ ID NO: 74, SEQ ID NO: 77, SEQ ID NO: 80, SEQ ID NO: 83, SEQ ID NO: 86, SEQ ID NO: 514, SEQ ID NO: 518, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 698, SEQ ID NO: 700, SEQ ID NO: 702, SEQ ID NO: 704, SEQ ID NO: 706, SEQ ID NO: 708, SEQ ID NO: 710, SEQ ID NO: 717, SEQ ID NO: 719, SEQ ID NO: 721, and SEQ ID NO: 723 or a sequence with at least one of at least 60%, at least 65%, at least 70%, at least 75%, at least 80%, at least 90% homology thereto, and
optionally, the cassette further comprises an FMOS terminator selected from the group consisting of at least one of SEQ ID NO: 3, SEQ ID NO: 21, SEQ ID NO: 24, SEQ ID NO: 27, SEQ ID NO: 30, SEQ ID NO: 36, SEQ ID NO: 48, SEQ ID NO: 51, SEQ ID NO: 54, SEQ ID NO: 57, SEQ ID NO: 63, SEQ ID NO: 66, SEQ ID NO: 72, SEQ ID NO: 75, SEQ ID NO: 78, SEQ ID NO: 81, SEQ ID NO: 84, SEQ ID NO: 87, SEQ ID NO: 515, SEQ ID NO: 519, SEQ ID NO: 699, SEQ ID NO: 701, SEQ ID NO: 703, SEQ ID NO: 705, SEQ ID NO: 707, SEQ ID NO: 709, SEQ ID NO: 718, SEQ ID NO: 720, SEQ ID NO: 722, and SEQ ID NO: 724 or a sequence with at least one of at least 60%, at least 65%, at least 70%, at least 75%, at least 80%, at least 90% homology thereto.

30. A plant produced by the method of 1-27.
31. A plant cell containing the cassette of 28-29.

Although a variety of FMOS regulatory sequences have been disclosed above, those of ordinary skill in the art will be readily able to produce FMOS regulatory sequence as set forth in the claims using Examples 1-4 below.

EXAMPLES

Example 1: Identifying Candidates for FMOS Regulatory Sequences

Candidates for use as FMOS regulatory sequences were identified by searching the crop species or related species for genes that fit two preliminary screening criteria:
1. Medium or high expression in tissues containing many de facto germline cells (floral tissues). This could include the inflorescence primordia, branch meristems, floral meristems, or anther or ovule primordia, which give rise to both somatic (non-reproductive) and germinal (reproductive) cell types. Exemplary FMOS candidates drive expression in anther and ovule cells that have acquired a reproductive cell fate (germinal, archesporial or sporogeneous cells, pollen mother cells or megaspore mother cells). Exemplary FMOS candidates may also have medium or high expression in meiotic cells (meiocytes) or post-meiotic gametophytic cells: microspores, megaspores, or the egg and sperm which undergo fertilization to produce the next generation.
2. Exemplary FMOS candidates have no expression or very low expression in precursor stem cells that give rise to the areal portions of the plant, including tissues that are transformed (in maize this means the embryo and callus). FMOS candidates should also be silent or have low expression in the shoot apical meristem. FMOS candidates should have low expression in the very early inflorescence meristem—and may turn on for the first time after the floral meristem has differentiated into the spikelet pair or floral meristems. Typical FMOS candidates will not have expression until floral development.

For maize genes, expression levels in SAM were classified as low', 'medium' or 'high' based upon their normalized expression values from an internal mRNASeq gene atlas study. In this study, quartiles were calculated using the complete matrix of normalized count values for all detected genes across 69 tissues/developmental stages. The quartiles provide thresholds for classifying individual gene expression values as low (less than first quartile), medium (expression value between first and third quartiles), and high (expression value greater than third quartile). Maize callus protein expression values were obtained from Supplemental Table S3 in Ge F, et al. (2017) Metabolomic and Proteomic Analysis of Maize Embryonic Callus induced from immature embryo. Scientific Reports 7(1):1004. This table contains a list of over 4,000 proteins identified in all 3 replicates of their proteomics analysis of maize embryonic callus. If our candidate gene was not included in the list of callus-expressed proteins, we classified its expression as 'off' in callus. Similarly, rice callus protein expression values were obtained from Abiko M et al. (2013) Identification of proteins enriched in rice egg or sperm cells by single-cell proteomics. PLoS One. July 25; 8(7):e69578. Supplemental Table S6 contains a list of proteins detected in rice callus by LC-MS/MS. As for maize genes, if our candidate gene was not included in the list of callus-expressed proteins, we classified its expression as 'off'. Similar criteria can be used to evaluate candidates for dicot plants as well.

In addition to identifying candidate sequences by measuring expression, those skilled in the art may identify candidate regulatory sequences based on gene expression data in plant tissue expression databases, known as gene atlases, which show the expression of many of the species' genes in different tissues to evaluate regulatory sequence candidates.

Presented below in Table 2 is a list of gene promoters applicant chose, and the construct designs that applicant ended up testing. All of these genes have floral preferred or specific expression. The levels of RNA or protein expression for the genes in the callus or shoot apical meristem of maize or rice tissue is also shown.

After analyzing gene atlas, microarray and RNA-seq data sets from a diversity of tissues and data sources, applicant selected eleven maize genes with reproductive lineage specific expression for testing for FMOS activity. Applicant also identified six rice genes (often, homologs of the maize genes that we found) that exhibited similar expression patterns in rice). Exemplary nominations included promoters that showed high preferential expression in anther and ovule primordia, and/or germinal cells (archesporial cells, pollen mother cells, megaspore mother cells, or meiocytes) of male and female reproductive organs.

TABLE 2

Table 2. Gene expression profiles and construct designs of FMOS candidates (17 in maize; 7 in rice)

| Construct # | Organism and Gene from which the promoter was captured | Promoter/ Terminator construct designs | ID | Floral Expressed Primordia, Meiosis, or Both? | Male/ Female/ Both | Maize SAM RNA | Maize Callus Protein | Rice Callus Protein |
|---|---|---|---|---|---|---|---|---|
| 24265 24266 24320 | *Zea Mays* BEARDED EAR1 (ZmBde1) | v1, no intron, tNOS v1 no intron, tBde v2 with intron, tBde | Zm00001d017614 | Both | Both | OFF | OFF | OFF |
| 24289 24299 | *Zea Mays* AGAMOUS5 (ZmAG5) | v2, no intron v3, with intron | Zm00001d051465 | Both/Primordia preferred | Both, but female preferred | OFF | OFF | OFF |
| 24269 | *Zea Mays* ARGONAUTE18A (ZmAGO18A) | v1, no intron | Zm00001d006351 | Primordia | Both | LOW | OFF | OFF |
| 24270 | *Zea Mays* ARGONAUTE5b (ZmAGO5b = ZmMEL1) | v1, no intron | Zm00001d007786 | Meiosis | Both | LOW | OFF | |
| 24243 24305 | *Oryza Sativa* MEIOSIS ARRESTED AT LEPTOTENE1 (OsMEL1 OsAGO5) | v1, no intron v2, with intron | Os07g09020 | Meiosis | Both | | | OFF OFF |
| 24602 | *Oryza Sativa* 4-coumarate CoA ligase (OsCoLig) | v1, no intron | Os04t0310800 | Meiosis | Male | | | OFF |
| 24306 | *Zea Mays* 4-coumarate CoA ligase (ZmCoLig) | v1, no intron | Zm00001d003702 | | | OFF | OFF | |
| 24460 | *Oryza Sativa* APETALA1 (OsAP1) | v1, with intron | Os07t01089000-02 | Both | Both | | | OFF |
| 24301 | *Zea Mays* APETALA1 (ZmAP1) | v1, with intron | Zm00001d007949 | | | LOW | OFF | |
| 24300 | *Zea Mays* ARGONAUTE18B (ZmAGO18B) | v1, no intron | Zm00001d033206 | | Meiotic anthers | Low | OFF | OFF |
| 24427 24428 | *Zea Mays* ABORTED MICROSPORES (ZmAMS) | v1, with intron and tAMS v1, with intron and tNOS | Zm00001d020430 | Meiosis | Male | OFF | OFF | OFF |
| 24458 | *Zea Mays* Teosinte Branched1 (ZmTBr1) | v1, no intron | Zm00001d032217 | Primordia | Both | MEDIUM | OFF | |
| 24459 | *Oryza Sativa* Teosinte Branched1 (ZmTBr1) | | Os08t0432300 | Primordia | Both | | | OFF |
| 24548 | *Zea Mays* RAMOSA2 (ZmRa2) | v1, no intron | Zm00001d013659 | Primordia | Male | MEDIUM | MEDIUM | OFF |
| 24454 | *Zea Mays* 3-hydroxypropionate dehydrogenase (ZmExine1) | v1, no intron | Zm00001d029683 | Both | Male | LOW | OFF | |
| 24455 | *Oryza Sativa* 3-hydroxypropionate dehydrogenase (OsExine1) | v1, with intron | Os10t0524500-01 | | | | | OFF |
| 24426 | *Oryza Sativa* C2H2 Zinc Finger Protein (OsZFP) | v1, no intron | Os04g36650-01 | Primordia | Both | | | OFF |
| 24688 | *Zea Mays* WUSCHEL2 (ZmWUS2) | v1, with intron | Zm00001d026537 | Primordia | Both | | | |
| 24606 | *Zea Mays* Thick Tassel Dwarf1 (ZmTD1) | v1, no intron | Zm00001d014793 | Primordia | Both | | | |

Example 2. Producing Constructs Comprising FMOS Regulatory Sequences

Once a candidate list of regulatory sequences was identified, activity was screened by building a construct using the promoter and terminators to drive expression of Cas9 and measuring the diversity of edits produced in the stably transformed plants (the T0 plants) and in the progeny (T1 plants).

Starting from the 19 FMOS candidates identified in Example 1, we designed 24 constructs, including different variations of the promoter sequences and 5' untranslated regions (UTRs), terminators, and in some instances we included as regulatory sequence a non-translatable first exon and intron and first 15 basepairs of the second exon (from the FMOS candidate gene). These sequences together constituted the regulatory region that flanked and drove expression of the coding sequence of Cas9. The guide RNA in all 24 of the constructs targeted exon 2 of ALCOHOL DEHYDROGENASE I (ADH1, GRMZM2G442658) with a target site sequence of 5'-cggcaagccactgtcgatcg-3' (SEQ ID NO: 6). The selectable marker was Phosphomannose Isomerase (PMI) and we used mannose selection to recover stably transformed plants of the maize inbred line NP2222.

One additional control construct had Cas9 driven by the constitutive CMP promoter.

FIG. 1 shows a schematic drawing of Vector 24301 (SEQ ID NO: 1) used for transformation of maize immature embryos to generate a plurality of different edits in the ZmADH1gene: promoter prZmAP1-01; terminator tZmAP1-01; guide RNA (gRNA) sequence; rsgR-NAZmVLHP-01: single guide RNA (sgRNA) comprising of gRNA, tracRNA and PolIII termination sequences. cPMI: PMI selectable marker gene; cCas9: Cas9 nuclease gene; RB: T-DNA right border; LB: T-DNA left border; tNOS: Nopaline synthetase terminator. cSpec: Spectinomycin resistance gene.

FIG. 3 is a schematic drawing of Vector 24224 (SEQ ID NO: 10) used for transformation of maize immature embryos.

FIG. 4 is a schematic drawing of Vector 24243 (SEQ ID NO: 40) used for transformation of maize immature embryos.

FIG. 5 is a schematic drawing of Vector 24265 (SEQ ID NO: 19) used for transformation of maize immature embryos.

FIG. 6 is a schematic drawing of Vector 24266 (SEQ ID NO: 22) used for transformation of maize immature embryos.

FIG. 7 is a schematic drawing of Vector 24269 (SEQ ID NO: 25) used for transformation of maize immature embryos.

FIG. 8 is a schematic drawing of Vector 24270 (SEQ ID NO: 28) used for transformation of maize immature embryos.

FIG. 9 is a schematic drawing of Vector 24289 (SEQ ID NO: 31) used for transformation of maize immature embryos.

FIG. 10 is a schematic drawing of Vector 24299 (SEQ ID NO: 34) used for transformation of maize immature embryos.

FIG. 11 is a schematic drawing of Vector 24300 (SEQ ID NO: 85) used for transformation of maize immature embryos.

FIG. 12 is a schematic drawing of Vector 24305 (SEQ ID NO: 43) used for transformation of maize immature embryos.

FIG. 13 is a schematic drawing of Vector 24306 (SEQ ID NO: 46) used for transformation of maize immature embryos.

FIG. 14 is a schematic drawing of Vector 24320 (SEQ ID NO: 49) used for transformation of maize immature embryos.

FIG. 15 is a schematic drawing of Vector 24426 (SEQ ID NO: 52) used for transformation of maize immature embryos.

FIG. 16 is a schematic drawing of Vector 24427 (SEQ ID NO: 55) used for transformation of maize immature embryos.

FIG. 17 is a schematic drawing of Vector 24428 (SEQ ID NO: 58) used for transformation of maize immature embryos.

FIG. 18 is a schematic drawing of Vector 24454 (SEQ ID NO: 61) used for transformation of maize immature embryos.

FIG. 19 is a schematic drawing of Vector 24455 (SEQ ID NO: 64) used for transformation of maize immature embryos.

FIG. 20 is a schematic drawing of Vector 24458 (SEQ ID NO: 67) used for transformation of maize immature embryos.

FIG. 21 is a schematic drawing of Vector 24459 (SEQ ID NO: 70) used for transformation of maize immature embryos.

FIG. 22 is a schematic drawing of Vector 24460 (SEQ ID NO: 73) used for transformation of maize immature embryos.

FIG. 23 is a schematic drawing of Vector 24548 (SEQ ID NO: 76) used for transformation of maize immature embryos.

FIG. 24 is a schematic drawing of Vector 24602 (SEQ ID NO: 79) used for transformation of maize immature embryos.

FIG. 25 is a schematic drawing of Vector 24688 (SEQ ID NO: 82) used for transformation of maize immature embryos.

Promoters and terminators used in the various vectors are also set forth, along with sequence information, below.

Example 3. Transforming Plants with Expression Cassettes Comprising FMOS Regulatory Sequences For each construct, we sent to the greenhouse between 10 and 20 single-copy T0 events (with the exception of 24265 which had a low transformation frequency and only produced two events). We sampled the seedlings and checked for single copy of the PMI and Cas9 transgenes, and we checked for editing at the ADH1 target site. We also checked for PMI and Cas9 expression in the seedling leaves.

We found that almost all of the constructs behaved as desired—there was one copy of the transgene by qPCR (see Secondary Taqman Assay data below), and the ADH1 target site was edited in the control construct (Vector 24224, see Taqman scores of 0 [both copies edited] or 1 [one copy edited, one WT]), but not in most of the FMOS candidate constructs (see Taqman scores of 2 [both copies still WT, or unedited]). Furthermore, the FMOS candidate constructs for the most part had PMI expression but not Cas9 expression in the leaves—further exhibiting the expression control is restricted from vegetative tissues. This was apparent in every construct tested, although not in every event. For example, 13 out of 13 events (transformed plants) with the control construct 24224 had editing at the ADH1 target site (8 of the plants had both copies of the ADH1 gene edited), and had expression of Cas9 more than 1000× higher than the control gene.

In contrast, the ZmAGO18A (ARGONAUTE 18A) promoter/terminator combination in the construct 24269 had editing in only two out of seventeen events, and expression over 1000× in only one event. Thus, the FMOS candidate is working as desired in 15 out of 17 events. The Aris gene has highly specific expression the germinal archesporial cells of maize anthers and ovules according to our databases and literature analysis. When the regulatory sequence is used to drive Cas9, editing does not occur, in most events, in the callus, and expression of the Cas9 is restricted, which is the desired performance in FMOS regulatory sequence candidates.

Likewise, in the construct with the ZmAP1 promoter/terminator, we found that none of the events had editing in the seedling leaf Taqman samples, and that the leaf expression of Cas9 is very low. These two regulatory regions thus represent promising FMOS candidates, in that they allow the transformed plants to remain unedited during vegetative development. Similarly, most of the other regulatory regions that we tested performed well in this seedling analysis, with the exception of the rice OsMEL1 promoters and terminators in constructs 24305 and 24243. We tested these two versions, and in most events both had editing occur during the callus or early vegetative meristem leading to edited ADH1 in the leaves.

TABLE 3

Table 3. The FMOS constructs tested, including leaf editing data (produced by Taqman qPCR assay) and qRT data from seedling leaf. The Taqman assays are qPCR assays run against a standard internal control that also happens to be ADH1 (a different region than was targeted by the guideRNA, and thus, the control assay is not affected by any small edits to the gene that may occur). For the transgene assays as well as the target-site PCR assays a Taqman qPCR score of "1" indicates one 'wild-type' copy of the gene (or transgene) is present. This is determined by in-plate comparison to control tissues. A "2" score indicates that two 'wild-type' copies are present. A "0" score indicates that zero wild-type copies are present; in other words that both target sites are edited. For the quantitative reverse transcriptase (qRT)-PCR data (the two columns on the right side of the table), the expression of the two transgenes, PMI and Cas9, is scored in reference to an internal standard assay. The number provided in those two columns represents the fold change over that internal control.

| | | | | Secondary Taqman Assays | | | qRT assay leaf | |
|---|---|---|---|---|---|---|---|---|
| Construct | Promoter | Terminator | Plant ID | PMI | Cas9 | ADH1 | PMI | Cas9 |
| 24224 | prCMP-04 | tNOS-05-01 | MZKE180705A119A | 1 | 1 | 0 | 4710 | 7110 |
| 24224 | prCMP-04 | tNOS-05-01 | MZKE180705A115A | 1 | 1 | 0 | 4263 | 8977 |
| 24224 | prCMP-04 | tNOS-05-01 | MZKE180705A112A | 1 | 1 | 0 | 4001 | 3317 |
| 24224 | prCMP-04 | tNOS-05-01 | MZKE180705A107A | 1 | 1 | 0 | 2966 | 3510 |
| 24224 | prCMP-04 | tNOS-05-01 | MZKE180705A053A | 1 | 1 | 0 | 1959 | 1884 |
| 24224 | prCMP-04 | tNOS-05-01 | MZKE180705A046A | 1 | 1 | 0 | 1500 | 1853 |
| 24224 | prCMP-04 | tNOS-05-01 | MZKE180705A008A | 1 | 1 | 0 | 1156 | 3610 |
| 24224 | prCMP-04 | tNOS-05-01 | MZKE180705A003A | 1 | 1 | 0 | 4787 | 2994 |
| 24224 | prCMP-04 | tNOS-05-01 | MZKE180705A109A | 1 | 1 | 1 | 2149 | 2568 |
| 24224 | prCMP-04 | tNOS-05-01 | MZKE180705A051A | 1 | 1 | 1 | 3918 | 5058 |
| 24224 | prCMP-04 | tNOS-05-01 | MZKE180705A044A | 1 | 1 | 1 | 2311 | 3492 |
| 24224 | prCMP-04 | tNOS-05-01 | MZKE180705A019A | 1 | 1 | 1 | 1604 | 2471 |
| 24224 | prCMP-04 | tNOS-05-01 | MZKE180705A011A | 1 | 1 | 1 | 1976 | 2019 |
| 24269 | prZmAGO18A-01 | tZmAGO18A-01 | MZKE181002A165A | 1 | 1 | 0 | 6285 | 0 |
| 24269 | prZmAGO18A-01 | tZmAGO18A-01 | MZKE181002A151A | 1 | 1 | 2 | 12281 | 1 |
| 24269 | prZmAGO18A-01 | tZmAGO18A-01 | MZKE181002A142A | 1 | 1 | 2 | 11267 | 6 |
| 24269 | prZmAGO18A-01 | tZmAGO18A-01 | MZKE181002A139A | 1 | 1 | 2 | 7752 | 4 |
| 24269 | prZmAGO18A-01 | tZmAGO18A-01 | MZKE181002A135A | 1 | 1 | 2 | 8082 | 7 |
| 24269 | prZmAGO18A-01 | tZmAGO18A-01 | MZKE181002A128A | 1 | 1 | 2 | 6185 | 1 |
| 24269 | prZmAGO18A-01 | tZmAGO18A-01 | MZKE181002A121A | 1 | 1 | 2 | 14079 | 3 |
| 24269 | prZmAGO18A-01 | tZmAGO18A-01 | MZKE181002A097A | 1 | 1 | 2 | 9004 | 1 |
| 24269 | prZmAGO18A-01 | tZmAGO18A-01 | MZKE181002A088A | 1 | 1 | 2 | 7094 | 2 |
| 24269 | prZmAGO18A-01 | tZmAGO18A-01 | MZKE181002A080A | 1 | 1 | 2 | 8833 | 1 |
| 24269 | prZmAGO18A-01 | tZmAGO18A-01 | MZKE181002A070A | 1 | 2 | 0 | 10575 | 4798 |
| 24269 | prZmAGO18A-01 | tZmAGO18A-01 | MZKE181002A061A | 1 | 1 | 2 | 5946 | 3 |
| 24269 | prZmAGO18A-01 | tZmAGO18A-01 | MZKE181002A045A | 1 | 1 | 2 | 2904 | 1 |
| 24269 | prZmAGO18A-01 | tZmAGO18A-01 | MZKE181002A040A | 1 | 1 | 2 | 1776 | 0 |
| 24269 | prZmAGO18A-01 | tZmAGO18A-01 | MZKE181002A017A | 1 | 1 | 2 | 4906 | 10 |
| 24269 | prZmAGO18A-01 | tZmAGO18A-01 | MZKE181002A015A | 1 | 1 | 2 | 18414 | 11 |
| 24269 | prZmAGO18A-01 | tZmAGO18A-01 | MZKE181002A003A | 1 | 1 | 2 | 1822 | 0 |
| 24270 | prZmAGO5B-01 | tZmAGO5B-01 | MZKE181100A145A | 1 | 1 | 2 | 3768 | 0 |
| 24270 | prZmAGO5B-01 | tZmAGO5B-01 | MZKE181100A120A | 1 | 1 | 2 | 2239 | 2 |
| 24270 | prZmAGO5B-01 | tZmAGO5B-01 | MZKE181100A146A | 1 | 1 | 2 | 6309 | 0 |
| 24270 | prZmAGO5B-01 | tZmAGO5B-01 | MZKE181100A141A | 1 | 1 | 2 | 10268 | 0 |
| 24270 | prZmAGO5B-01 | tZmAGO5B-01 | MZKE181100A086A | 1 | 1 | 2 | 8817 | 0 |
| 24270 | prZmAGO5B-01 | tZmAGO5B-01 | MZKE181100A113A | 1 | 1 | 2 | 7037 | 0 |
| 24270 | prZmAGO5B-01 | tZmAGO5B-01 | MZKE181100A105A | 1 | 1 | 2 | 4392 | 0 |
| 24270 | prZmAGO5B-01 | tZmAGO5B-01 | MZKE181100A140A | 1 | 1 | 2 | 14642 | 0 |
| 24270 | prZmAGO5B-01 | tZmAGO5B-01 | MZKE181100A082A | 1 | 1 | 2 | 3897 | 0 |
| 24270 | prZmAGO5B-01 | tZmAGO5B-01 | MZKE181100A173A | 1 | 1 | 2 | 10218 | 0 |
| 24270 | prZmAGO5B-01 | tZmAGO5B-01 | MZKE181100A079A | 1 | 1 | 2 | 5757 | 0 |
| 24270 | prZmAGO5B-01 | tZmAGO5B-01 | MZKE181100A102A | 1 | 1 | 0 | 8847 | 0 |
| 24270 | prZmAGO5B-01 | tZmAGO5B-01 | MZKE181100A134A | 1 | 1 | 0 or 1 | 6487 | 108 |
| 24270 | prZmAGO5B-01 | tZmAGO5B-01 | MZKE181100A158A | 1 | 1 | 2 | 10686 | 0 |
| 24270 | prZmAGO5B-01 | tZmAGO5B-01 | MZKE181100A057A | 1 | 1 | 2 | 6451 | 0 |

TABLE 3-continued

Table 3. The FMOS constructs tested, including leaf editing data (produced by Taqman qPCR assay) and qRT data from seedling leaf. The Taqman assays are qPCR assays run against a standard internal control that also happens to be ADH1 (a different region than was targeted by the guideRNA, and thus, the control assay is not affected by any small edits to the gene that may occur). For the transgene assays as well as the target-site PCR assays a Taqman qPCR score of "1" indicates one 'wild-type' copy of the gene (or transgene) is present. This is determined by in-plate comparison to control tissues. A "2" score indicates that two 'wild-type' copies are present. A "0" score indicates that zero wild-type copies are present; in other words that both target sites are edited. For the quantitative reverse transcriptase (qRT)-PCR data (the two columns on the right side of the table), the expression of the two transgenes, PMI and Cas9, is scored in reference to an internal standard assay. The number provided in those two columns represents the fold change over that internal control.

| | | | | Secondary Taqman Assays | | | qRT assay leaf | |
|---|---|---|---|---|---|---|---|---|
| Construct | Promoter | Terminator | Plant ID | PMI | Cas9 | ADH1 | PMI | Cas9 |
| 24270 | prZmAGO5B-01 | tZmAGO5B-01 | MZKE181100A031A | 1 | 1 | 2 | 3087 | 0 |
| 24270 | prZmAGO5B-01 | tZmAGO5B-01 | MZKE181100A029A | 1 | 1 | 2 | 4399 | 0 |
| 24266 | prZmBde1-01 | tZmBde1-01 | MZKE181200A094A | 1 | 1 | 2 | 10048 | 8 |
| 24266 | prZmBde1-01 | tZmBde1-01 | MZKE181200A088A | 1 | 1 | 2 | 9464 | 3 |
| 24266 | prZmBde1-01 | tZmBde1-01 | MZKE181200A083A | 1 | 1 | >2 | 17880 | 5 |
| 24266 | prZmBde1-01 | tZmBde1-01 | MZKE181200A080A | 1 | 1 | 2 | 5573 | 9 |
| 24266 | prZmBde1-01 | tZmBde1-01 | MZKE181200A078A | 1 | 1 | 2 | 8414 | 19 |
| 24266 | prZmBde1-01 | tZmBde1-01 | MZKE181200A074A | 1 | 1 | >2 | 27145 | 26 |
| 24266 | prZmBde1-01 | tZmBde1-01 | MZKE181200A071A | 1 | 1 | 2 | 32661 | 5 |
| 24266 | prZmBde1-01 | tZmBde1-01 | MZKE181200A036A | 1 | 1 | 2 | 21100 | 218 |
| 24266 | prZmBde1-01 | tZmBde1-01 | MZKE181200A034A | 1 or 2 | 1 or 2 | >2 | 10862 | 10 |
| 24266 | prZmBde1-01 | tZmBde1-01 | MZKE181200A033A | 1 | 1 | 2 | 8519 | 24 |
| 24266 | prZmBde1-01 | tZmBde1-01 | MZKE181200A031A | 1 | 1 | 2 | 9219 | 48 |
| 24266 | prZmBde1-01 | tZmBde1-01 | MZKE181200A030A | 1 | 1 | 2 | 12088 | 25 |
| 24266 | prZmBde1-01 | tZmBde1-01 | MZKE181200A008A | 1 | 1 | 2 | 10644 | 0 |
| 24265 | prZmBde1-01 | tNOS-05-01 | MZKE181302A002A | 1 | 1 | 2 | 3187 | 0 |
| 24243 | prOsMEL1-01 | tOsMEL1-01 | MZKE181401A020A | 1 | 1 | 1 | 3626 | 0 |
| 24243 | prOsMEL1-01 | tOsMEL1-01 | MZKE181401A019A | 1 | 1 | 1 | 2607 | 0 |
| 24243 | prOsMEL1-01 | tOsMEL1-01 | MZKE181401A018A | 1 | 1 | 1 | 2043 | 0 |
| 24243 | prOsMEL1-01 | tOsMEL1-01 | MZKE181401A016A | 1 | 1 | 1 | 5973 | 1 |
| 24243 | prOsMEL1-01 | tOsMEL1-01 | MZKE181401A014A | 1 | 1 | 1 or 2 | 3330 | 0 |
| 24243 | prOsMEL1-01 | tOsMEL1-01 | MZKE181401A013A | 1 | 1 | 0 | 3033 | 0 |
| 24243 | prOsMEL1-01 | tOsMEL1-01 | MZKE181401A012A | 1 | 1 | >2 | 1779 | 0 |
| 24243 | prOsMEL1-01 | tOsMEL1-01 | MZKE181401A010A | 1 | 1 | 2 | 3062 | 1 |
| 24243 | prOsMEL1-01 | tOsMEL1-01 | MZKE181401A008A | 1 | 1 | 0 or 1 | 4324 | 0 |
| 24243 | prOsMEL1-01 | tOsMEL1-01 | MZKE181401A007A | 1 | 1 | 1 | 3505 | 0 |
| 24243 | prOsMEL1-01 | tOsMEL1-01 | MZKE181401A003A | 1 | 1 | 0 | 2452 | 1 |
| 24243 | prOsMEL1-01 | tOsMEL1-01 | MZKE181401A002A | 2 | 1 | 2 | 1549 | 0 |
| 24243 | prOsMEL1-01 | tOsMEL1-01 | MZKE181401A001A | 1 | 1 | 0 or 1 | 2129 | 14 |
| 24243 | prOsMEL1-01 | tOsMEL1-01 | MZKE181401A017A | 1 | 1 | 1 | 5235 | 0 |
| 24299 | prZmAG5-01 | tZmAG5-01 | MZKE181501A022A | 1 | 1 | 2 | 10207 | 3 |
| 24299 | prZmAG5-01 | tZmAG5-01 | MZKE181501A020A | 1 or 2 | 2 | 0 | 16191 | 27 |
| 24299 | prZmAG5-01 | tZmAG5-01 | MZKE181501A019A | 1 | 1 | 2 | 2783 | 0 |
| 24299 | prZmAG5-01 | tZmAG5-01 | MZKE181501A017A | 1 | 1 | 2 | 8390 | 53 |
| 24299 | prZmAG5-01 | tZmAG5-01 | MZKE181501A016A | 1 | 1 | 2 | 5201 | 97 |
| 24299 | prZmAG5-01 | tZmAG5-01 | MZKE181501A014A | 1 | 1 | 2 | 7441 | 41 |
| 24299 | prZmAG5-01 | tZmAG5-01 | MZKE181501A012A | 1 | 1 | 2 | 5137 | 7 |
| 24299 | prZmAG5-01 | tZmAG5-01 | MZKE181501A010A | 1 | 1 | 2 | 3162 | 1 |
| 24299 | prZmAG5-01 | tZmAG5-01 | MZKE181501A007A | 1 | 1 | 2 | 1986 | 24 |
| 24299 | prZmAG5-01 | tZmAG5-01 | MZKE181501A005A | 1 | 1 | 2 | 10720 | 70 |
| 24299 | prZmAG5-01 | tZmAG5-01 | MZKE181501A001A | >2 | 2 | 1 | 11994 | 89 |
| 24300 | prZmAGO18B-01 | tZmAGO18B-01 | MZKE181704A080A | 1 | 1 | 2 | 7309 | 0 |
| 24300 | prZmAGO18B-01 | tZmAGO18B-01 | MZKE181704A074A | 1 | 1 | 2 | 19603 | 0 |
| 24300 | prZmAGO18B-01 | tZmAGO18B-01 | MZKE181704A060A | 1 | 1 | 2 | 7891 | 0 |
| 24300 | prZmAGO18B-01 | tZmAGO18B-01 | MZKE181704A059A | 1 | 1 | 2 | 6160 | 1 |
| 24300 | prZmAGO18B-01 | tZmAGO18B-01 | MZKE181704A057A | 1 | 1 | 2 | 9314 | 0 |
| 24300 | prZmAGO18B-01 | tZmAGO18B-01 | MZKE181704A056A | 1 | 1 | 2 | 17382 | 1 |
| 24300 | prZmAGO18B-01 | tZmAGO18B-01 | MZKE181704A048A | 1 | 1 | 2 | 3671 | 0 |
| 24300 | prZmAGO18B-01 | tZmAGO18B-01 | MZKE181704A046A | 1 | 1 | 2 | 2721 | 0 |
| 24300 | prZmAGO18B-01 | tZmAGO18B-01 | MZKE181704A041A | 1 | 1 | 2 | 6930 | 0 |
| 24300 | prZmAGO18B-01 | tZmAGO18B-01 | MZKE181704A038A | 1 | 1 | 2 | 4494 | 0 |
| 24300 | prZmAGO18B-01 | tZmAGO18B-01 | MZKE181704A033A | 1 | 1 | 2 | 2907 | 0 |
| 24300 | prZmAGO18B-01 | tZmAGO18B-01 | MZKE181704A032A | 1 | 1 | 2 | 16393 | 1 |
| 24300 | prZmAGO18B-01 | tZmAGO18B-01 | MZKE181704A022A | 1 | 1 | 2 | 2414 | 0 |
| 24300 | prZmAGO18B-01 | tZmAGO18B-01 | MZKE181704A017A | 1 | 1 | 2 | 4028 | 0 |
| 24300 | prZmAGO18B-01 | tZmAGO18B-01 | MZKE181704A015A | 1 | 1 | 2 | 2177 | 0 |
| 24300 | prZmAGO18B-01 | tZmAGO18B-01 | MZKE181704A011A | 1 | 1 | 2 | 4546 | 0 |
| 24289 | prZmAG5-02 | tZmAG5-01 | MZKE181801A061A | 1 | 1 | 2 | 12059 | 105 |
| 24289 | prZmAG5-02 | tZmAG5-01 | MZKE181801A051A | 1 | 1 | 2 | 15130 | 12 |
| 24289 | prZmAG5-02 | tZmAG5-01 | MZKE181801A050A | 1 | 1 | >2 | 16511 | 2 |
| 24289 | prZmAG5-02 | tZmAG5-01 | MZKE181801A045A | 1 | 1 | 2 | 14865 | 16 |
| 24289 | prZmAG5-02 | tZmAG5-01 | MZKE181801A044A | 1 | 1 | 2 | 19036 | 15 |
| 24289 | prZmAG5-02 | tZmAG5-01 | MZKE181801A041A | 1 | 1 | 2 | 9490 | 0 |
| 24289 | prZmAG5-02 | tZmAG5-01 | MZKE181801A036A | 1 | 1 | 2 | 15861 | 10 |

TABLE 3-continued

Table 3. The FMOS constructs tested, including leaf editing data (produced by Taqman qPCR assay) and qRT data from seedling leaf. The Taqman assays are qPCR assays run against a standard internal control that also happens to be ADH1 (a different region than was targeted by the guideRNA, and thus, the control assay is not affected by any small edits to the gene that may occur). For the transgene assays as well as the target-site PCR assays a Taqman qPCR score of "1" indicates one 'wild-type' copy of the gene (or transgene) is present. This is determined by in-plate comparison to control tissues. A "2" score indicates that two 'wild-type' copies are present. A "0" score indicates that zero wild-type copies are present; in other words that both target sites are edited. For the quantitative reverse transcriptase (qRT)-PCR data (the two columns on the right side of the table), the expression of the two transgenes, PMI and Cas9, is scored in reference to an internal standard assay. The number provided in those two columns represents the fold change over that internal control.

| Construct | Promoter | Terminator | Plant ID | Secondary Taqman Assays | | | qRT assay leaf | |
|---|---|---|---|---|---|---|---|---|
| | | | | PMI | Cas9 | ADH1 | PMI | Cas9 |
| 24289 | prZmAG5-02 | tZmAG5-01 | MZKE181801A031A | 1 | 1 | 2 | 10335 | 1 |
| 24289 | prZmAG5-02 | tZmAG5-01 | MZKE181801A030A | 1 | 1 | 2 | 9103 | 4 |
| 24289 | prZmAG5-02 | tZmAG5-01 | MZKE181801A029A | 1 | 1 | 2 | 5109 | 7 |
| 24289 | prZmAG5-02 | tZmAG5-01 | MZKE181801A023A | 1 | 1 | 2 | 27185 | 8 |
| 24289 | prZmAG5-02 | tZmAG5-01 | MZKE181801A015A | 0 or 1 | 1 | 2 | 6695 | 2 |
| 24289 | prZmAG5-02 | tZmAG5-01 | MZKE181801A014A | 1 | 1 | 2 | 16723 | 5 |
| 24289 | prZmAG5-02 | tZmAG5-01 | MZKE181801A008A | 1 | 1 | 2 | 24398 | 18 |
| 24289 | prZmAG5-02 | tZmAG5-01 | MZKE181801A003A | 1 | 1 | 2 | 15252 | 129 |
| 24301 | prZmAP1-01 | tZmAP1-01 | MZKE181800A067A | 1 | 1 | 2 | 19013 | 11 |
| 24301 | prZmAP1-01 | tZmAP1-01 | MZKE181800A063A | 1 | 1 | 2 | 20000 | 22 |
| 24301 | prZmAP1-01 | tZmAP1-01 | MZKE181800A084A | 1 | 1 | 2 | 14806 | 11 |
| 24301 | prZmAP1-01 | tZmAP1-01 | MZKE181800A074A | 1 | 1 | 2 | 41505 | 5 |
| 24301 | prZmAP1-01 | tZmAP1-01 | MZKE181800A078A | 1 or 2 | 1 or 2 | 2 | 16586 | 6 |
| 24301 | prZmAP1-01 | tZmAP1-01 | MZKE181800A064A | 1 | 1 | 2 | 12821 | 16 |
| 24301 | prZmAP1-01 | tZmAP1-01 | MZKE181800A073A | 1 | 1 | 2 | 10119 | 3 |
| 24301 | prZmAP1-01 | tZmAP1-01 | MZKE181800A056A | 1 | 1 | 2 | 11979 | 8 |
| 24301 | prZmAP1-01 | tZmAP1-01 | MZKE181800A050A | 1 | 1 | 2 | 7273 | 7 |
| 24301 | prZmAP1-01 | tZmAP1-01 | MZKE181800A044A | 1 | 1 | 2 | 10548 | 6 |
| 24301 | prZmAP1-01 | tZmAP1-01 | MZKE181800A033A | 1 | 1 | 2 | 30225 | 11 |
| 24301 | prZmAP1-01 | tZmAP1-01 | MZKE181800A022A | 1 or 2 | 1 | >2 | 15785 | 18 |
| 24301 | prZmAP1-01 | tZmAP1-01 | MZKE181800A021A | 1 | 1 | 2 | 9229 | 7 |
| 24301 | prZmAP1-01 | tZmAP1-01 | MZKE181800A019A | 1 | 1 | 2 | 19510 | 22 |
| 24301 | prZmAP1-01 | tZmAP1-01 | MZKE181800A004A | 1 | 1 | 2 | 9768 | 31 |
| 24305 | prOsMEL1-02 | tOsMEL1-01 | MZKE181900A095A | 1 | 1 | 1 | 3267 | 2 |
| 24305 | prOsMEL1-02 | tOsMEL1-01 | MZKE181900A083A | 1 | 1 | 1 | 5249 | 5 |
| 24305 | prOsMEL1-02 | tOsMEL1-01 | MZKE181900A079A | 1 | 1 | 2 | 2747 | 2 |
| 24305 | prOsMEL1-02 | tOsMEL1-01 | MZKE181900A073A | 1 | 1 | 1 | 1884 | 3 |
| 24305 | prOsMEL1-02 | tOsMEL1-01 | MZKE181900A072A | 1 | 1 | 1 | 2960 | 8 |
| 24305 | prOsMEL1-02 | tOsMEL1-01 | MZKE181900A064A | 1 | 1 | 1 | 3590 | 4 |
| 24305 | prOsMEL1-02 | tOsMEL1-01 | MZKE181900A062A | 1 | 1 | 1 | 1835 | 4 |
| 24305 | prOsMEL1-02 | tOsMEL1-01 | MZKE181900A053A | 1 | 1 | 2 | 2631 | 1 |
| 24305 | prOsMEL1-02 | tOsMEL1-01 | MZKE181900A049A | 1 | 1 | 1 | 1964 | 2 |
| 24305 | prOsMEL1-02 | tOsMEL1-01 | MZKE181900A034A | 1 | 1 | >2 | 13697 | 3 |
| 24305 | prOsMEL1-02 | tOsMEL1-01 | MZKE181900A033A | 1 | 1 | 1 | 3678 | 4 |
| 24305 | prOsMEL1-02 | tOsMEL1-01 | MZKE181900A030A | 1 | 1 | 1 | 3933 | 2 |
| 24305 | prOsMEL1-02 | tOsMEL1-01 | MZKE181900A029A | 1 | 1 | 1 | 2162 | 2 |
| 24305 | prOsMEL1-02 | tOsMEL1-01 | MZKE181900A025A | 1 | 1 | 1 | 5055 | 5 |
| 24305 | prOsMEL1-02 | tOsMEL1-01 | MZKE181900A022A | 1 | 1 | 1 or 2 | 2500 | 2 |
| 24305 | prOsMEL1-02 | tOsMEL1-01 | MZKE181900A007A | 1 | 1 | 1 | 5784 | 8 |
| 24306 | prZmCoLig-01 | tZmCoLig-01 | MZKE181901A068A | 1 | 1 | 2 | 7237 | 0 |
| 24306 | prZmCoLig-01 | tZmCoLig-01 | MZKE181901A095A | 1 | 1 | 2 | 4254 | 1 |
| 24306 | prZmCoLig-01 | tZmCoLig-01 | MZKE181901A078A | 1 | 1 | 2 | 9166 | 1 |
| 24306 | prZmCoLig-01 | tZmCoLig-01 | MZKE181901A069A | 1 | 1 | 2 | 4704 | 0 |
| 24306 | prZmCoLig-01 | tZmCoLig-01 | MZKE181901A065A | 1 | 1 | 2 | 6417 | 0 |
| 24306 | prZmCoLig-01 | tZmCoLig-01 | MZKE181901A064A | 1 | 1 | 2 | 5882 | 0 |
| 24306 | prZmCoLig-01 | tZmCoLig-01 | MZKE181901A054A | 1 | 1 | 2 | 6999 | 0 |
| 24306 | prZmCoLig-01 | tZmCoLig-01 | MZKE181901A045A | 1 | 1 | 2 | 6891 | 1 |
| 24306 | prZmCoLig-01 | tZmCoLig-01 | MZKE181901A044A | 1 | 1 | 2 | 5873 | 0 |
| 24306 | prZmCoLig-01 | tZmCoLig-01 | MZKE181901A039A | 1 | 1 | 2 | 8732 | 0 |
| 24306 | prZmCoLig-01 | tZmCoLig-01 | MZKE181901A037A | 1 | 1 | 2 | 4269 | 0 |
| 24306 | prZmCoLig-01 | tZmCoLig-01 | MZKE181901A035A | 1 | 1 | 2 | 2952 | 1 |
| 24306 | prZmCoLig-01 | tZmCoLig-01 | MZKE181901A030A | 1 | 1 | 2 | 7959 | 0 |
| 24306 | prZmCoLig-01 | tZmCoLig-01 | MZKE181901A027A | 1 | 1 | 2 | 9832 | 0 |
| 24306 | prZmCoLig-01 | tZmCoLig-01 | MZKE181901A020A | 1 | 1 | 2 | 3038 | 1 |
| 24306 | prZmCoLig-01 | tZmCoLig-01 | MZKE181901A015A | 1 | 1 | 2 | 4857 | 1 |
| 24306 | prZmCoLig-01 | tZmCoLig-01 | MZKE181901A009A | 1 | 1 | 2 | 1277 | 0 |
| 24320 | prZmBde1-02 | tZmBde1-01 | MZKE182000A081A | 1 | 1 | 2 | 4981 | 11 |
| 24320 | prZmBde1-02 | tZmBde1-01 | MZKE182000A080A | 1 | 1 | 2 | 9493 | 13 |
| 24320 | prZmBde1-02 | tZmBde1-01 | MZKE182000A064A | 1 | 1 | 2 | 5319 | 6 |
| 24320 | prZmBde1-02 | tZmBde1-01 | MZKE182000A063A | 1 | 1 | 2 | 3859 | 4 |
| 24320 | prZmBde1-02 | tZmBde1-01 | MZKE182000A057A | 1 | 1 | 2 | 3746 | 10 |
| 24320 | prZmBde1-02 | tZmBde1-01 | MZKE182000A055A | 1 | 1 | 2 | 3918 | 6 |
| 24320 | prZmBde1-02 | tZmBde1-01 | MZKE182000A045A | 1 | 1 | 2 | 3810 | 6 |
| 24320 | prZmBde1-02 | tZmBde1-01 | MZKE182000A033A | 1 | 1 | 2 | 3749 | 8 |

TABLE 3-continued

Table 3. The FMOS constructs tested, including leaf editing data (produced by Taqman qPCR assay) and qRT data from seedling leaf. The Taqman assays are qPCR assays run against a standard internal control that also happens to be ADH1 (a different region than was targeted by the guideRNA, and thus, the control assay is not affected by any small edits to the gene that may occur). For the transgene assays as well as the target-site PCR assays a Taqman qPCR score of "1" indicates one 'wild-type' copy of the gene (or transgene) is present. This is determined by in-plate comparison to control tissues. A "2" score indicates that two 'wild-type' copies are present. A "0" score indicates that zero wild-type copies are present; in other words that both target sites are edited. For the quantitative reverse transcriptase (qRT)-PCR data (the two columns on the right side of the table), the expression of the two transgenes, PMI and Cas9, is scored in reference to an internal standard assay. The number provided in those two columns represents the fold change over that internal control.

| | | | | Secondary Taqman Assays | | | qRT assay leaf | |
|---|---|---|---|---|---|---|---|---|
| Construct | Promoter | Terminator | Plant ID | PMI | Cas9 | ADH1 | PMI | Cas9 |
| 24320 | prZmBde1-02 | tZmBde1-01 | MZKE182000A031A | 1 | 1 | 2 | 13423 | 8 |
| 24320 | prZmBde1-02 | tZmBde1-01 | MZKE182000A029A | 1 | 1 | 2 | 1984 | 5 |
| 24320 | prZmBde1-02 | tZmBde1-01 | MZKE182000A028A | 1 | 1 | 2 | 2158 | 3 |
| 24320 | prZmBde1-02 | tZmBde1-01 | MZKE182000A027A | 1 | 1 | 2 | 4568 | 4 |
| 24320 | prZmBde1-02 | tZmBde1-01 | MZKE182000A019A | 1 | 1 | 2 | 6149 | 10 |
| 24320 | prZmBde1-02 | tZmBde1-01 | MZKE182000A006A | 1 | 1 | 2 | 7249 | 6 |
| 24320 | prZmBde1-02 | tZmBde1-01 | MZKE182000A005A | 1 | 1 | 2 | 3633 | 26 |
| 24320 | prZmBde1-02 | tZmBde1-01 | MZKE182000A002A | 1 | 1 | >2 | 5335 | 15 |
| 24460 | prOsAP1-01 | tOsAP1-01 | MZKE184306A109A | 1 | 1 | 2 | 8337 | 7 |
| 24460 | prOsAP1-01 | tOsAP1-01 | MZKE184306A107A | 1 | 1 | 2 | 9140 | 3 |
| 24460 | prOsAP1-01 | tOsAP1-01 | MZKE184306A104A | 1 | 1 | 2 | 7943 | 10 |
| 24460 | prOsAP1-01 | tOsAP1-01 | MZKE184306A075A | 1 | 1 | 2 | 9273 | 6 |
| 24460 | prOsAP1-01 | tOsAP1-01 | MZKE184306A062A | 1 | 1 | 2 | 24772 | 18 |
| 24460 | prOsAP1-01 | tOsAP1-01 | MZKE184306A060A | 1 | 1 | 2 | 44891 | 2 |
| 24460 | prOsAP1-01 | tOsAP1-01 | MZKE184306A048A | 1 | 1 | 2 | 6442 | 2 |
| 24460 | prOsAP1-01 | tOsAP1-01 | MZKE184306A047A | 1 | 1 | 2 | 13505 | 0 |
| 24460 | prOsAP1-01 | tOsAP1-01 | MZKE184306A042A | 1 | 1 | 2 | 15771 | 3 |
| 24460 | prOsAP1-01 | tOsAP1-01 | MZKE184306A034A | 1 | 1 | 2 | 18058 | 3 |
| 24460 | prOsAP1-01 | tOsAP1-01 | MZKE184306A030A | 1 | 1 | 2 | 17525 | 3 |
| 24460 | prOsAP1-01 | tOsAP1-01 | MZKE184306A018A | 1 | 1 | 2 | 17355 | 6 |
| 24460 | prOsAP1-01 | tOsAP1-01 | MZKE184306A017A | 1 | 1 | 2 | 28095 | 0 |
| 24460 | prOsAP1-01 | tOsAP1-01 | MZKE184306A014A | 1 | 1 | 2 | 21020 | 8 |
| 24460 | prOsAP1-01 | tOsAP1-01 | MZKE184306A008A | 1 | 1 | 2 | 18969 | 3 |

The control construct exhibited highly efficient editing in the leaves according to the consistent Wildtype ADH1 Taqman assay score of "0" or "1" in each event, meaning that either 1 or both copies of the ADH1 target site carried a new mutation induced by the editing machinery. In contrast, the FMOS candidates predominantly left the ADH1 target site intact, presumably due to low expression of the Cas9 protein in the callus, meristem, and immature leaves. Low expression of the Cas9 RNA and CAS9 protein in the FMOS promoter constructs were verified by checking for qRT-PCR and ELISA data for each event. The two versions of the rice MEL1 promoter (MEIOSIS ARRESTED AT LEPTOTENE1) generated numerous events with edits in the leaf but low Cas9 expression; most likely the editing is due to callus or vegetative meristem expression of Cas9 when it is paired with the OsMEL1 regulatory regions. This is an example of a candidate regulatory sequence with a distinctive, meiotic-specific phenotype, however, it is not an ideal FMOS candidate due to early expression in the callus or vegetative meristem. We discarded plants or constructs that showed editing in the callus or vegetative meristem, as indicated by editing in the leaves. Because leaves come from meristems, we reasoned that leaf edits implied meristem edits.

We focused FMOS regulatory sequences were used to generate events having a plurality of edits in the flowers (as determined by tassel editing and mosaicism assays discussed in Example 4 and illustrated in Table 4).

Example 4. Producing a Plurality of Unique Edits and Confirming Floral-Enriched Expression of the Editing Machinery Two tassel editing and mosaicism assays were used to illustrate performance of the FMOS regulatory sequences. Both assays indicated whether there was editing at the ADH1 target site—the first assay was a pollen ADH1 biochemical assay performed using dehydrogenase staining and can be used to quickly provide an efficient readout adh1 function among pollen collected from up to 48 different positions on the tassel. The second assay, target side DNA-seq by next generation sequences (NGS) was only performed on tassel samples from those positions on the T0 events that showed a high degree of editing in the adh1 pollen assay screen. The NGS assay reveals the diversity of edits at the target site. Thus by combining the data from the first and second screen, we were able to produce a very high quality data set showing the degree of floral editing efficiency and mosaicism in different parts of the tassel. The NGS data for the promoters was then analyzed by mutation type and position on the tassel in order to calculate a mosaicism score, which approximated the average number of distinct editing events detected in a given tassel of a T0 event.

FIG. 26 illustrates tassel sampling from each event for the assays. Each event's tassels were sampled from 24-48 times. Pre-anthesis-staged spikelets were harvested and the upper and floret anthers were put into the wells of a 96-well plate in a standard order, as shown—the positions were the same in each plate. If we did not have enough side branches to fill up rows C and D, or G and H, we simply stopped at the number of side branches we had in each event.

To quantify the degree of editing and the diversity of editing events in the tassel, twenty-four to forty-eight tassel spikelets (flowers) are taken from different sites on the tassel (each tassel has hundreds of spikelets), and the three anthers of the upper floret of each spikelet are pinched in half with forceps and loaded into a well of 96-well ADH1 staining plate. Each well of this plate contains 800 µl 0.1M Tris-HCl (pH 6.7) at room temperature. The three lower floret anthers from each spikelet are put into a corresponding well of a 96-well DNA sequencing plate for storage in the −80 freezer. The pollen in the staining plate were stained for ADH1 activity using a protocol from Wisman, et al. Genetic and molecular characterization of an Adh-1 null mutant *Mol Gen Genet* 1991 226: 120-128 that we adapted for 96-well plate screening, to enable high throughput analysis of floral sectors.

Briefly, staining plates were frozen overnight at −20° C. and thawed for 2-3 hours. Pollen was collected by pipetting through a 96-well 40 µm nylon mesh fritted filter plate. This was blotted dry and set into a 96-well collection plate; each well had 400 uL of MTT staining buffer, which contains 94% v/v 0.1M Tris-HCL, 6% v/v ethanol, 0.3 g/L nicotinamide adenine dinucleotide (NAD), 0.2 g/L 3-(4,5-dimethylthiazol-2-yl)-2,5-diphenyltetrazolium bromide (MTT), and 40 mg/L phenazine methosulphate (PMS). The plate is then covered and incubated at 28° C. in the dark for one hour. Wild type pollen stains purple. Pollen that has lost ADH1 activity remains unstained (clear). ADH1 is not required for pollen development, viability, or fertilization. Eleven percent non-viable pollen was detected in WT control samples. Samples that had <1% ADH1 positive pollen were scored as fully edited; samples with >90% ADH1 positive pollen were scored as unedited. Partially edited entries were characterized by the % of ADH1 positive pollen in the well, estimated into increments of 5% (i.e. 5%, 10%, 15, 20%, 25%, 30%, 35%, 40%, 45% 50%, 55%, 60%, 65%, 70%, 75%, 80%, 85%, 90% and 95%). The average percentage was normalized (−11%, based on the control). Diversity of edits was evaluated by the frequency of different % ADH1+ brackets. The constructs that had mosaicism and high editing efficiency were nominated for NGS to further illustrate diversity of edits.

TABLE 4

Table 4. ADH1 staining scores (average of hundreds of samples). These data encouraged us to focus our pollen sequencing efforts on the three constructs 24301, 24320, and 24269, which had the highest amount of putatively edited pollen. Eight of the twelve FMOS promoters showed <50% editing. The % adh1 pollen edited was calculated for those events which did not show editing in the leaf sample. The % of pollen edited was calculated by subtracting the % WT ADH1+ pollen by 100. This number was then normalized by subtracting 11%, which was the average % of unstained pollen in the WT sample.

| construct | FMOS promoter candidate | # plants stained for ADH1 activity | % ADH1+ pollen (WT) | Calculated % adh1 pollen | Event notes |
|---|---|---|---|---|---|
| 24224 | CMP control (early) | 3 | 0% | 100% | control |
| 24301 | prZmAP1-01 | 11 | 15% | 85% (74% after normalization) | 11/14 events look the most edited |
| 24320 | prZmBde1-02 | 13 | 29% | 71% (60% after normalization) | 10/13 events look the most edited |
| 24269 | prZmAGO18A-01 | 15 | 31% | 69% (58% after normalization) | 13/15 events look the most edited |
| 24460 | prOsAP1-01 | 15 | 8% | 92% (81% after normalization) | 13/15 events were highly edited |
| 24243 | prOsMEL1-01 | 5 | 42% | 58% (47%) | |
| 24299 | prZmAG5-01 | 10 | 55% | 45% (34%) | |
| 24270 | prZmAGO5B-01 | 16 | 58% | 42% (31%) | |
| 24289 | prZmAG5-02 | 13 | 66% | 34% (23%) | |
| 29300 | prZmAGO18B-01 | 16 | 66% | 34% (23%) | |
| 24306 | prZmCoLig-01 | 14 | 66% | 34% (23%) | |
| 24266 | prZmBde1-01 | 8 | 71% | 29% (18%) | |
| 24305 | prOsMEL1-02 | 3 | 77% | 23% (12%) | |
| | Wild Type | 10 | 89% | 11% (0%) | 11% non-viable pollen |

Despite predicted expression in germinal lineages, Table 4 shows that eight FMOS promoter candidates showed >50% WT pollen via ADH1 staining. One reason for this may be that those FMOS candidates had floral but not germinal expression. Despite our use of many high quality expression data sets, in many cases the samples contained mixtures of germinal cells and somatic cells. Another possible explanation is low expression activity in a heterologous context, due to missing chromatin features or distal sequences. Cis-enhancers can be hundreds of kilobases away from the genes that they enhance in maize. The selection of FMOS promoters may further be assisted by improved RNAseq data from specific reproductive lineage cells and by utilization of chromatin landscape studies such as ChIP-seq, ATAC-seq, DNAse I-seq, M Nase-seq, or other data types. This would thus lead to the design of chimeric promoters with different enhancers, promoters, introns, and terminators to induce high, specific expression in reproductive cells.

The ADH1 staining also helped examine the extent of mosaicism in the editing of the ADH1 gene. By looking at 24 to 48 samples from different locations on the tassel, we can see that the extent of editing differs. For instance, Table 5 below shows construct 24320 ADH1 pollen stain results for 14 events (over 7 plates). In the first event, GVG00887355, some anther samples had more WT pollen (40%, in well A4) than other anther samples (5% in well B7). This is a sign of mosaicism—if the editing had occurred very early in development, all of the wells would have "0%" WT pollen, as is the case with the control CMP promoter (see Table 6).

TABLE 5

Table 5. An example of pollen staining results is shown. This was for 14 events from construct 24320. The numbers in each well represent the percentage of stained (unedited) pollen. Some events like GVG00887372 did not have much editing, but 11 out of 14 had highly efficient editing. The prevalence of some samples in the plates that had higher and lower degrees of editing indicate mosaicism.

| 24320 | 1 | 2 | 3 | 4 | 5 | 6 | 7 | 8 | 9 | 10 | 11 | 12 | Plant Event ID | Leaf Taqman Assay Score |
|---|---|---|---|---|---|---|---|---|---|---|---|---|---|---|
| A | 15 | 25 | 25 | 40 | 25 | 25 | 30 | 30 | 30 | 25 | 15 | 15 | MZKE182000A080A | 2 |
| B | 15 | 15 | 25 | 15 | 25 | 25 | 5 | 15 | 25 | 25 | 25 | 15 | | |
| C | | | | | | | | | | | | | | |
| D | | | | | | | | | | | | | | |
| E | 5 | 15 | 15 | 5 | 25 | 25 | 25 | 25 | 25 | 25 | 40 | 25 | MZKE182000A064A | 2 |
| F | 5 | 5 | 25 | 25 | 25 | 25 | 10 | 25 | 10 | 25 | 30 | 25 | | |
| G | 10 | 10 | 25 | 25 | 25 | 25 | 25 | 5 | 10 | 25 | 15 | 15 | | |
| H | 10 | 25 | 25 | 25 | 25 | 25 | 25 | 10 | 25 | 25 | 15 | 15 | | |
| A | 75 | 75 | 80 | 80 | 80 | 80 | 80 | 80 | 80 | 80 | 75 | 50 | MZKE182000A063A | 2 |
| B | 0 | 80 | 75 | 80 | 80 | 80 | 75 | 80 | 80 | 80 | 80 | 80 | | |
| C | 60 | 50 | 60 | 60 | 60 | 0 | 80 | 80 | 80 | 60 | 60 | ND | | |
| D | 2 | 75 | 75 | 75 | 75 | 75 | | | | | | | | |
| E | 25 | 10 | 25 | 25 | 25 | 40 | 25 | 30 | 25 | 15 | 25 | 25 | MZKE182000A057A | 2 |
| F | 15 | 15 | 15 | 15 | 25 | 10 | 10 | 15 | 10 | 15 | 15 | 25 | | |
| G | 50 | 40 | 50 | 25 | 30 | 30 | 0 | 5 | 15 | 10 | 20 | 25 | | |
| H | 25 | 25 | 5 | 40 | 25 | 40 | 10 | 15 | 10 | 30 | 15 | 50 | | |
| A | 5 | 5 | 10 | 0 | 5 | 0 | 10 | 10 | 15 | 20 | 10 | 5 | MZKE182000A055A | 2 |
| B | 0 | 2 | 5 | 0 | 0 | 0 | 5 | 5 | 15 | 25 | 15 | 0 | (row D was WT | |
| C | 0 | 0 | 5 | 5 | 0 | 0 | | | | | | | control) | |
| D | 80 | 80 | 90 | 90 | 90 | 90 | 90 | 90 | 90 | 90 | 90 | 90 | | |
| E | 5 | 5 | 5 | 10 | 20 | 10 | 25 | 20 | 25 | 10 | 15 | 15 | MZKE182000A045A | 2 |
| F | 0 | 10 | 10 | 10 | 10 | 10 | 0 | 0 | 10 | 5 | 5 | 0 | | |
| G | 10 | 0 | 10 | 10 | 5 | 10 | | | | | | | | |
| H | | | | | | | | | | | | | | |
| E | 75 | 80 | 80 | 80 | 80 | 80 | 80 | 80 | 80 | 80 | 80 | 80 | MZKE182000A031A | 2 |
| F | 80 | 80 | 80 | 80 | 80 | 80 | 50 | 60 | 75 | 50 | 60 | 75 | | |
| G | 75 | 60 | 75 | 40 | 75 | 50 | | | | | | | | |
| H | 5 | 15 | 10 | 10 | 25 | 25 | 5 | 5 | 15 | 10 | 30 | 15 | | |
| A | 50 | 75 | 75 | 60 | 75 | 60 | 75 | 60 | 50 | 50 | 40 | 30 | MZKE182000A029A | 2 |
| B | 75 | 75 | 75 | 60 | 75 | 30 | 50 | 75 | 75 | 75 | 50 | 50 | | |
| C | | | | | | | | | | | | | | |
| D | | | | | | | | | | | | | | |
| E | 5 | 0 | 0 | 10 | 5 | 15 | 10 | 10 | 5 | 10 | 10 | 10 | MZKE182000A028A | 2 |
| F | 5 | 5 | 2 | 0 | 10 | 5 | 5 | 0 | 2 | 0 | 10 | 10 | | |
| G | 0 | 0 | 0 | 10 | 10 | 10 | 15 | 0 | 0 | 5 | 5 | 5 | | |
| H | 5 | 0 | 10 | 5 | 5 | 5 | 0 | 0 | 10 | 0 | 0 | 5 | | |
| A | 5 | 0 | 10 | 15 | 15 | 15 | 15 | 20 | 25 | 15 | 10 | 15 | MZKE182000A019A | 2 |
| B | 10 | 25 | 15 | 10 | 0 | 10 | 5 | 10 | 15 | 5 | 0 | 0 | | |
| C | 10 | 10 | 15 | 5 | 15 | 5 | 10 | 5 | 2 | 5 | 5 | 5 | | |
| D | | | | | | | | | | | | | | |
| E | 15 | 25 | 30 | 30 | 30 | 25 | 25 | 50 | 30 | 30 | 30 | 20 | MZKE182000A006A | 2 |
| F | 20 | 10 | 20 | 25 | 20 | 25 | 0 | 25 | 15 | 25 | 25 | 15 | | |
| G | 0 | 30 | 30 | 40 | 40 | 40 | 5 | 15 | 15 | 20 | 20 | 10 | | |
| H | | | | | | | | | | | | | | |
| A | 80 | 80 | 80 | 80 | 80 | 80 | 80 | 80 | 80 | 80 | 80 | 80 | MZKE182000A005A | 2 |
| B | 80 | 80 | 80 | 80 | 80 | ND | 80 | 80 | 80 | 80 | 80 | 80 | | |
| C | 80 | 80 | 80 | 80 | 80 | 50 | 80 | 80 | 80 | 80 | 80 | | | |
| D | | | | | | | | | | | | | | |
| E | 10 | 15 | 15 | 25 | 30 | 50 | 25 | 30 | 25 | 30 | 40 | 15 | MZKE182000A002A | 2 |
| F | 15 | 25 | 30 | 40 | 25 | 0 | 10 | 25 | 15 | 15 | 40 | 50 | | |
| G | 10 | 15 | 25 | 25 | 25 | 10 | 30 | 40 | 40 | 40 | 30 | 30 | | |
| H | 10 | 15 | 25 | 25 | 25 | 15 | 0 | 25 | 25 | 30 | 30 | 15 | | |

TABLE 6

Table 6. Control construct 24224 (CMP constitutive promoter) showing 100% editing in the pollen.

| 24224 Control | 1 | 2 | 3 | 4 | 5 | 6 | 7 | 8 | 9 | 10 | 11 | 12 | Plant Event ID | Leaf Taqman Assay Score |
|---|---|---|---|---|---|---|---|---|---|---|---|---|---|---|
| A | 0 | 0 | 0 | 0 | 0 | 0 | 0 | 0 | 0 | 0 | 0 | 0 | GVG00884767 | 0 |
| B | 0 | 0 | 0 | 0 | 0 | 0 | 0 | 0 | 0 | 0 | 0 | | | |
| C | | | | | | | | | | | | | | |
| D | | | | | | | | | | | | | | |
| E | 0 | 0 | 0 | 0 | 0 | 0 | 0 | 0 | 0 | 0 | 0 | 0 | GVG00885801 | 0 |
| F | 0 | 0 | 0 | 0 | 0 | 0 | 0 | 0 | 0 | 0 | 0 | | | |
| G | 0 | 0 | 0 | 0 | 0 | 0 | 0 | 0 | 0 | 0 | | | | |
| H | 0 | 0 | 0 | 0 | 0 | 0 | | | | | | | | |

TABLE 6-continued

Table 6. Control construct 24224 (CMP constitutive promoter) showing 100% editing in the pollen.

| 24224 Control | 1 | 2 | 3 | 4 | 5 | 6 | 7 | 8 | 9 | 10 | 11 | 12 | Plant Event ID | Leaf Taqman Assay Score |
|---|---|---|---|---|---|---|---|---|---|---|---|---|---|---|
| A | 0 | 0 | 0 | 0 | 0 | 0 | 0 | 0 | 0 | 0 | 0 | 0 | GVG00886575 | 0 |
| B | 0 | 0 | 0 | 0 | 0 | 0 | 0 | 0 | 0 | 0 | 0 | | | |
| C | 0 | 0 | 0 | 0 | 0 | 0 | 0 | 0 | 0 | 0 | 0 | | | |
| D | | | | | | | | | | | | | | |

TABLE 7

Table 7. ADH1 staining results for 24305 which exhibited too-early expression of the Cas9 in many of the events, as indicated by edited assay data (score of 0 or 1) in the leaf. This results in a lack of mosaicism in the tassel (most/all wells in those events show nearly 100% editing).

| 24305 | 1 | 2 | 3 | 4 | 5 | 6 | 7 | 8 | 9 | 10 | 11 | 12 | Plant Event ID | Leaf Taqman Assay Score |
|---|---|---|---|---|---|---|---|---|---|---|---|---|---|---|
| A | 0 | 0 | 0 | 0 | 0 | 0 | 0 | 0 | 0 | 0 | 0 | 0 | MZKE181900A095A | 1 |
| B | 0 | 0 | 0 | 0 | 0 | 0 | 0 | 0 | 0 | 0 | 0 | | | |
| C | 0 | 0 | 0 | 0 | 0 | 0 | 0 | 0 | 0 | 0 | 0 | | | |
| D | | | | | | | | | | | | | | |
| E | 80 | 80 | 80 | 80 | 90 | 80 | 75 | 80 | 80 | 80 | 80 | 95 | MZKE181900A079A | 2 |
| F | 75 | 80 | 75 | 75 | 80 | 80 | 80 | 90 | 90 | 75 | 50 | 60 | | |
| G | 80 | 90 | 80 | 90 | 80 | 75 | 75 | 80 | 80 | 75 | 90 | 80 | | |
| H | 80 | 80 | 75 | 80 | 90 | 60 | 40 | 80 | 75 | 75 | 90 | 90 | | |
| A | 0 | 10 | 10 | 10 | 10 | 5 | 0 | 0 | 2 | 0 | 0 | 2 | MZKE181900A073A | 0 or 1 |
| B | 0 | 0 | 2 | 0 | 0 | 0 | 0 | 0 | 0 | 0 | 0 | | | |
| C | 0 | 0 | 0 | 0 | 0 | 0 | | | | | | | | |
| D | | | | | | | | | | | | | | |
| E | 0 | 2 | 0 | 0 | 0 | 2 | 0 | 0 | 0 | 0 | 0 | 0 | MZKE181900A072A | 1 |
| F | 0 | 0 | 0 | 0 | 0 | 0 | 0 | 0 | 0 | 0 | 0 | | | |
| G | 0 | 0 | 0 | 0 | 0 | 0 | 0 | 0 | 0 | 0 | 0 | | | |
| H | 0 | 0 | 0 | 0 | 0 | 0 | 0 | 0 | 0 | 0 | 0 | | | |
| A | 0 | 0 | 0 | 0 | 0 | 0 | 0 | 0 | 0 | 0 | 0 | 0 | MZKE181900A064A | 1 |
| B | 0 | 0 | 0 | 0 | 0 | 0 | 0 | 0 | 0 | 0 | 0 | | | |
| C | 0 | 0 | 0 | 0 | 0 | 0 | 0 | 0 | 0 | 0 | 0 | | | |
| D | 0 | 0 | 0 | 0 | 0 | 0 | 0 | 0 | 0 | 0 | | | | |
| E | 0 | 0 | 0 | 0 | 0 | 0 | | | | | | | MZKE181900A053A | 2 |
| F | 90 | 80 | 80 | 80 | 90 | 80 | 80 | 75 | 80 | 80 | 75 | 80 | | |
| G | 80 | 75 | 75 | 80 | 80 | 75 | 75 | 75 | 75 | 60 | 75 | 60 | | |
| H | 90 | 80 | 75 | 80 | 75 | 80 | 80 | 75 | 75 | 75 | 75 | 75 | | |
| A | 2 | 5 | 5 | 5 | 10 | 5 | 15 | 15 | 15 | 10 | 10 | 0 | MZKE181900A049A | 0 or 1 |
| B | 10 | 10 | 15 | 10 | 5 | 15 | 5 | 10 | 15 | 0 | 0 | 0 | | |
| C | 5 | 10 | 15 | 10 | 5 | 5 | 5 | 5 | 2 | 0 | 0 | | | |
| D | 10 | 10 | 20 | 10 | 5 | 5 | | | | | | | | |
| E | 75 | 75 | 75 | 75 | 75 | 75 | 75 | 75 | 75 | 75 | 75 | 75 | MZKE181900A034A | 2 |
| F | 75 | 75 | 75 | 75 | 75 | 75 | 75 | 75 | 60 | 60 | 75 | 60 | | |
| G | 75 | 75 | 75 | 75 | 75 | 60 | | | | | | | | |
| H | | | | | | | | | | | | | | |
| A | 0 | 0 | 0 | 0 | 0 | 0 | 0 | 0 | 0 | 0 | 0 | 0 | MZKE181900A033A | 1 |
| B | 0 | 5 | 5 | 0 | 10 | 0 | 5 | 0 | 0 | 0 | 0 | | | |
| C | 0 | 2 | 5 | 5 | 2 | 0 | 5 | 0 | 0 | 0 | 0 | | | |
| D | 0 | 0 | 0 | 5 | 0 | 0 | 0 | 0 | 0 | 0 | | | | |
| E | 10 | 0 | 0 | 0 | 10 | 0 | 0 | 0 | 0 | 30 | 0 | MZKE181900A029A | | 1 |
| F | 10 | 10 | 15 | 10 | 15 | 10 | 10 | 15 | 10 | 15 | 10 | 0 | | |
| G | 0 | 0 | 0 | 0 | 0 | 0 | 10 | 15 | 15 | 15 | 15 | 15 | | |
| H | | | | | | | | | | | | | | |
| A | 0 | 0 | 0 | 0 | 0 | 0 | 0 | 0 | 0 | 0 | 0 | 0 | MZKE181900A025A | 1 |
| B | 0 | 0 | 0 | 0 | 0 | 0 | 0 | 0 | 0 | 0 | 0 | | | |
| C | 0 | 0 | 0 | 0 | 0 | 0 | 0 | 0 | 0 | 0 | 0 | | | |
| D | 0 | 0 | 0 | 0 | 0 | 0 | 0 | 0 | 0 | 0 | | | | |
| E | 50 | 40 | 50 | 40 | 40 | 40 | 40 | 40 | 30 | 40 | 30 | MZKE181900A022A | | 1 |
| F | 40 | 40 | 40 | 40 | 30 | 30 | 40 | 40 | 50 | 50 | 40 | 40 | | |
| G | 40 | 50 | 40 | 50 | 40 | 40 | 40 | 40 | 50 | 50 | 40 | 40 | | |
| H | 30 | 30 | 50 | 40 | 50 | 40 | | | | | | | | |

TABLE 7a

Table 7a. ADH1 staining results for 24460. 13 out of 15 events had highly efficient editing. The prevalence of some samples in the plates that had higher and lower degrees of editing indicate mosaicism.

| 24460 | 1 | 2 | 3 | 4 | 5 | 6 | 7 | 8 | 9 | # | # | # | Plant Event ID | Leaf Taqman Assay Score |
|---|---|---|---|---|---|---|---|---|---|---|---|---|---|---|
| A | 0 | 0 | 0 | 0 | 0 | 0 | 0 | 0 | 0 | 0 | 10 | 0 | GVG01156066 | 2 |
| B | 0 | 0 | 0 | 0 | 0 | 10 | ND | 0 | 0 | 0 | 0 | 0 | | |
| C | 0 | 0 | 0 | 0 | 0 | 0 | 0 | 0 | 0 | 0 | 0 | 0 | | |
| D | ND | | | | | | | | | | | | | |
| E | 0 | 0 | 0 | 0 | 0 | 0 | 0 | 5 | 0 | 0 | 0 | 0 | GVG01156067 | 2 |
| F | 0 | 0 | 0 | 0 | 0 | 0 | 0 | 0 | 0 | 0 | 0 | 0 | | |
| G | 0 | 0 | 0 | 0 | 0 | 0 | 0 | 25 | 0 | 0 | 10 | 0 | | |
| H | 0 | 0 | 0 | 0 | 0 | 0 | 0 | 0 | 0 | 0 | 20 | 0 | | |
| A | 20 | 0 | 0 | 0 | 0 | 0 | 0 | 0 | 0 | 0 | 10 | 10 | GVG01156075 | 2 |
| B | 0 | 0 | 0 | 0 | 0 | 0 | 0 | 0 | 0 | 0 | 0 | 0 | | |
| C | 0 | 0 | 0 | 0 | 0 | 0 | 0 | 0 | 5 | 0 | 0 | 0 | | |
| D | 0 | 0 | 0 | 0 | 0 | 5 | 0 | 0 | 0 | 0 | 0 | 5 | | |
| E | 0 | 20 | 0 | 0 | 0 | 0 | 0 | 5 | 0 | 0 | 5 | 0 | GVG01156082 | 2 |
| F | 0 | 0 | 0 | 0 | 20 | 0 | 0 | 0 | 0 | 0 | 0 | 0 | | |
| G | 0 | 0 | 0 | 0 | 0 | 0 | 0 | 10 | 0 | 0 | 0 | 0 | | |
| H | 0 | 0 | 0 | 0 | 0 | 0 | 0 | 0 | 0 | 0 | 0 | 0 | | |
| A | 0 | 0 | 0 | 0 | 0 | 5 | 0 | 0 | 0 | 0 | 0 | 0 | GVG01156086 | 2 |
| B | 0 | 0 | 0 | 0 | 0 | 0 | 0 | 0 | 0 | 0 | 0 | 0 | | |
| C | 0 | 0 | 0 | 5 | 0 | 0 | 0 | 0 | 0 | 0 | 0 | 0 | | |
| D | 0 | 0 | 0 | 0 | 0 | 0 | 0 | 0 | 0 | 0 | 0 | 5 | | |
| E | 0 | 0 | 0 | 0 | 5 | 0 | 0 | 5 | 0 | 0 | 0 | 5 | GVG01156087 | 2 |
| F | 0 | 0 | 0 | 0 | 0 | 0 | 0 | 0 | 0 | 0 | 0 | 0 | | |
| G | 5 | 0 | 0 | 0 | 0 | 0 | 0 | 0 | 0 | 10 | 0 | 0 | | |
| H | 0 | 0 | 0 | 0 | 0 | 0 | 0 | 0 | 0 | 0 | 0 | 0 | | |
| A | 0 | 0 | 0 | 5 | 0 | 0 | 0 | 5 | 0 | 0 | 0 | 0 | GVG01156085 | 2 |
| B | 0 | 5 | 0 | 0 | 0 | 0 | 0 | 0 | 0 | 0 | 0 | 0 | | |
| C | 0 | 0 | 0 | 0 | 0 | 0 | ND | | | | | | | |
| D | 0 | 0 | 0 | 0 | 0 | 5 | 0 | 0 | 5 | 0 | 5 | 5 | | 2 |
| E | 0 | 0 | 10 | 0 | 0 | 0 | 0 | 0 | 0 | 0 | 0 | 0 | GVG01156083 | |
| F | 0 | 0 | ND | 15 | 0 | 0 | 0 | 0 | 0 | 0 | 0 | 0 | | |
| G | 0 | 0 | 0 | 0 | 0 | 0 | 0 | 0 | 10 | 0 | 0 | 0 | | |
| H | 0 | 0 | 0 | 20 | 0 | 0 | 0 | 0 | 0 | 0 | 0 | 0 | | |
| A | 75 | 50 | 75 | 75 | 50 | 60 | 75 | 75 | 75 | 60 | 60 | 60 | GVG01156065 | 2 |
| B | 30 | 15 | 40 | 40 | 60 | 40 | 15 | 50 | 50 | 60 | 75 | 50 | | |
| C | 25 | 50 | 60 | 60 | 50 | 80 | ND | | 50 | 60 | 75 | 50 | | |
| D | | | | | | | | | | | | | | |
| E | 0 | 0 | 5 | 0 | 0 | 5 | 0 | 0 | 0 | 0 | 0 | 5 | GVG01156072 | 2 |
| F | 0 | 0 | 0 | 0 | 0 | 0 | 0 | 0 | 0 | 0 | 0 | 0 | | |
| G | 0 | 0 | 0 | 0 | 0 | 0 | 0 | 0 | 0 | 0 | 0 | 0 | | |
| H | ND | | | | | ND | | | | | | | | |
| A | 0 | 0 | 0 | 0 | 0 | 0 | 5 | 15 | 5 | 5 | 5 | 0 | GVG01156074 | 2 |
| B | 0 | 0 | 0 | 0 | 0 | 0 | 0 | 0 | 0 | 0 | 5 | 0 | | |
| C | 0 | 0 | 5 | 25 | 5 | 0 | 0 | 0 | 0 | 0 | 0 | 0 | | |
| D | ND | | | | | | | | | | | | | |
| E | 60 | 75 | 75 | 75 | 75 | 75 | 75 | 75 | 80 | 90 | 75 | 75 | GVG01156079 | 2 |
| F | 60 | 80 | 80 | 80 | 80 | 75 | 75 | 75 | 75 | 80 | 75 | 75 | | |
| G | 75 | 75 | 75 | 75 | 75 | 75 | 75 | 75 | 75 | 75 | 75 | 80 | | |
| H | 75 | 75 | 75 | 75 | 75 | 80 | ND | | | | | | | |
| A | 5 | 0 | 0 | 0 | 0 | 0 | 0 | 0 | 0 | 0 | #15 | 5 | GVG01156080 | 2 |
| B | 0 | 0 | 0 | 0 | 0 | 3 | 0 | 0 | 0 | 0 | 0 | 0 | | |
| C | 0 | 15 | 0 | 0 | #30 | 0 | 0 | 0 | 0 | 0 | 0 | 5 | | |
| D | 0 | 0 | 0 | 40 | 0 | 0 | 0 | 0 | 0 | 0 | 5 | 0 | | |
| E | 0 | 0 | 0 | 0 | 0 | 0 | 0 | 0 | #20 | 0 | 5 | 5 | GVG01156084 | 2 |
| F | 0 | 0 | 0 | 5 | 0 | 0 | 0 | #10 | 0 | 0 | 0 | 0 | | |
| G | 30 | 0 | 0 | 0 | 0 | 0 | 0 | 0 | 0 | 0 | 0 | 0 | | |
| H | 0 | 0 | 0 | 0 | 0 | 0 | ND | | | | | | | |
| A | 0 | 0 | 0 | 4 | 0 | 0 | 5 | 0 | 0 | 0 | 5 | 0 | GVG01156081 | 1 or 2 |
| B | 0 | 0 | 0 | 0 | 0 | 0 | 0 | 0 | 0 | 0 | 0 | 0 | | |
| C | 0 | 0 | 0 | 0 | 0 | 25 | 0 | 0 | 0 | 0 | 0 | 0 | | |
| D | 0 | 0 | 0 | 0 | 0 | 0 | 0 | 0 | 0 | 0 | 0 | 0 | | |
| E | 0 | 0 | 0 | 0 | 0 | 0 | ND | | | | | | | |

The ADH1 assay was an inexpensive, first-pass screen for determining editing diversity, while the DNA-sequencing of the ADH1 target site is a more specific evaluation. In this example, we only performed sequencing on constructs that indicated no or rare instances of editing in leaves but >50% ADH1-edited pollen by the ADH1 staining assay. For those selected events in constructs 24301, 24320, 24460, 24305, and 24269, anther samples were removed from the −80 freezer and genomic DNA was extracted. PCR amplification of the ADH1 target site was performed on each sample. PCR amplicons were sent for next-generation sequencing. A cut-off of 1% read abundance was set for sequences to be considered "real".

We present here molecular analysis pipeline developed and implemented internally in enabling high throughput screening and characterization of genome editing events, including high throughput TaqMan analysis, Sanger sequencing and ICE analysis, Next Generation Sequencing (NGS) and Genome Editing analysis.

Mosaicism Score Methodology 1:

Measurement of the FMOS activity of any promoter driving a nuclease and/or a guideRNA can be directly measured using a three step process to determine a "mosaicism score" via Mosaicism Score Methodology 1. A mosaicism score can be calculated using this process for each T0 event or of plants of later generations. This scoring methodology can be used for any flowering plant or crop.

Step 1) Sample the T0 inflorescence or inflorescences or inflorescence parts (i.e. anthers and carpels) between four and up to several hundred times. Create a map of the inflorescence or the whole plant indicating where the different samples were taken from for tracking purposes. The nature of this map may depend on the plant. In maize, we organized it by tassel branches. In soybean or tomato, one may use branches or clusters of flowers.

Step 2) Perform NGS on those samples, set a 1% cut-off for the % read and create individual plant maps for each edit obtained.

Step 3) Use the maps to calculate the mosaicism score as follows: the first edit is counted once, all subsequent edits, if adjacent to a sample with the same edit within that same branch/cluster, are only counted if the % read is >15% different from the adjacent % read (one may exclude % reads of less than 10% from this adjacency criteria). Sum all of the counted edits across all editing types (alleles) for the entire plant, and divide by the number of samples. This gives the mosaicism score for that plant. The mosaicism score is equal to the number of unique edits identified per sample.

Applicant considers mosaicism scores greater than 0.5 to be considered "functional" FMOS promoters. Scores greater than 2 should be considered "good". Scores greater than 5 should be considered "very good" FMOS promoters. Scores greater than 10 should be considered "excellent" FMOS promoters. Scores greater than 15 should be considered "elite" FMOS promoters.

An example of mosaicism score measured in corn using Mosaicism Score Methodology 1 is provided below.

High Throughput TaqMan Screening

For edit cutting site analysis, target specific primers are designed to flank the expected editing region with target specific probe placed at the edit cutting site. Quantitative real-time PCR was carried out for copy number analysis in high throughput screening of genome editing events. Two copy of the target site indicate no editing, one copy indicates one allele get edited, and zero copy indicates both alleles get edited. Real-time PCR was set up in 384-well plates. Reactions were multiplexed to simultaneously amplify the target gene and endogenous control gene. For each sample, the Taqman Assay was setup by combining 3 µl of extracted genomic DNA with 3 µl master mix containing Jumpstart Taq ReadyMix (Sigma) supplemented with primers to a final concentration of 300 nM each and probes to a final concentration of 100 nM each. The 384-well plates were heat sealed, and the real-time PCR was carried out in either the ABI 7900 Real-time PCR machine or the Life Technologies Quant Studio Flex 7 instrument, using the following parameters: 95° C. for 5 minutes, 40 cycles of 95° C. for 5 seconds and 60° C. for 30 seconds. Post-run data analysis was performed according to the manufacturer's instructions.

For allele replacement/target insertion analysis, unique TaqMan assays could also been designed to fit for specific purpose (not described here).

NGS (Next Generation Sequencing) and Genome Editing Analysis Pipeline

Events were characterized using GNS and genome editing analysis.

Genome editing analysis was designed to detect and characterize target sequence change or allele replacements using NGS data.

Applicant performed the following tasks for analysis:
Retrieves Illumina reads from NGS repository
Trims Reads
Merges paired-end reads
Samples reads (rather than using all reads)
Aligns merged reads to WT reference
Align WT reference and reference with desired allele replacements (allele replacement events only)
Call variants in reference with desired allele replacements (allele replacement events only)
Call variants between individual reads and WT reference
Identify the presence and location of partial alignments
Identify variants held in common by reads
Determine variant frequencies and remove low frequency variants
Identify variant induced frameshifts
Assess the effect of phased indels on reading frame
Determine haplotypes
Make results report
Archive results in NGS repository Others however may prefer other ways to evaluate their pipeline.

DNA is extracted and purified in 96-well plates standard lab protocol. If the sample amount is limited, such as less pollen grains, reduce amount of extraction buffer and elution buffer accordingly. Target specific primers are designed to flank the target editing region. For Adh1 editing analysis, target specific primer 1 (FE4228) of CTAACTCGTT-GAGTGGCCCTG (SEQ ID NO: 546), and target specific primer 2 (FE4229) of CAGATAAGCCGCCAAGAAGG (SEQ ID NO: 546) were designed. NGS universal TAG sequences are added to the designed target specific primers.

PCR reactions were set up in 96-well plate, with high fidelity polymerase such as Q5. For each PCR reaction, 12.5 ul of 2× Q5 Hot Start High-Fidelity master mix, 1.25 ul of primer 1, 1.25 ul of primer 2, 4 ul DNA, and 6 ul H2O was added and mixed. PCR amplification was run under following conditions:

| 1 cycle | 98° C. | 30 sec. |
| 35 cycles | 98° C. | 10 sec. |
| | 65° C. | 20 sec. |
| | 72° C. | 20 sec. |
| 1 cycle | 72° C. | 2 min. |
| 1 cycle | 4° C. | hold |

PCR product was checked for its quality, diluted with H2O at 1:50 or 1:100 ratio, and used for next generation sequencing. In NGS library preparation, a nested PCR was carried out to add sample specific barcode and sequencing TAGs to each sample. Up to 384 barcoded samples were pooled together and sequenced by Miseq with 2×250 bp or 2×300 bp paired-end reads.

To capture heterogeneous editing with low frequency, the default analysis parameters were adjusted accordingly, such as, increasing "number of reads to analyze" to >=1000, decreasing "minimum variant percentage" to =<1%. When the "minimum variant percentage" is set low, potentially more false positive SNPs could show up. To help evaluate false positives, a number of WT samples were included in the process and analysis.

```
Adh1 target reference used in NGS analysis
(SEQ ID NO: 548):
ctaactcgttgagtggccctgtttctcggacgtaaggcctttgctgct
ccacacatgtccattcgaattttaccgtgtttagcaagggcgaaaagt
ttgcatcttgatgatttagcttgactatgcgattgctttcctggaccc
gtgcagctgcggtggcatgggaggccggcaagccactgtcgatcgagg
aggtggaggtagcgcctccgcaggccatggaggtgcgcgtcaagatcc
tcttcacctcgctctgccacaccgacgtctacttctgggaggccaagg
tatctaatcagccatcccatttgtgatctttgtcagtagatatgatac
aacaactcgcggttgacttgcgccttcttggcggcttatctg
```

Sanger Sequencing and ICE Analysis Pipeline

As an alternative to NGS, others may prefer Sanger sequencing and Inference of CRISPR Edits (ICE) (developed by Synthego Inc.) for high throughput sequencing analysis of genome editing events. Primer design, PCR, clean-up of PCR product, and Sanger sequencing follows standard lab protocols.

In order to use this data to estimate mosaicism, it was important that we determined which edits were likely to be independent (as in, made in different cells of the developing plant) and which were counted as part of putative clonal sectors (which derived from a single cell, where that edit originally occurred). Better FMOS activity would be associated with the former—more independent edits, occurring later in plant development, than the latter—edits detected that are part of the same clonally-derived cell sector. In order to do this, for each edit (e.g. mutation, variant, transgenic event), the edits were mapped onto a diagram of the tassel. This diagram is referred to as the "tassel map" for each variant. See Table 8 for a good demonstration of our editing evaluation in practice. For that example, the four base pair deletion of TCGA, which was a very common edit overall, is shown for two different events, including the sample plate and position with the 96 well plate. To understand and manage the mosaic sector pattern, we converted raw sequence reads (as seen in Table 8) into a tassel map (as seen in Table 9) for easy neighbor/adjacency analysis.

TABLE 8

| Variant (edit) | Pedigree (Event ID) | Sample Position | Read Percentage |
|---|---|---|---|
| 182: Delete TCGA | MZKE181002A045A | NGS18017_A02 | 3% |
| 182: Delete TCGA | MZKE181002A045A | NGS18017_C02 | 1% |
| 182: Delete TCGA | MZKE181002A045A | NGS18017_A03 | 25% |
| 182: Delete TCGA | MZKE181002A045A | NGS18017_A04 | 26% |
| 182: Delete TCGA | MZKE181002A045A | NGS18017_A06 | 32% |
| 182: Delete TCGA | MZKE181002A045A | NGS18017_C07 | 1% |
| 182: Delete TCGA | MZKE181002A045A | NGS18017_A09 | 29% |
| 182: Delete TCGA | MZKE181002A045A | NGS18017_D10 | 2% |
| 182: Delete TCGA | MZKE181002A045A | NGS18017_C11 | 1% |
| 182: Delete TCGA | MZKE181002A151A | NGS18017_E01 | 2% |
| 182: Delete TCGA | MZKE181002A151A | NGS18017_G01 | 1% |
| 182: Delete TCGA | MZKE181002A151A | NGS18017_F02 | 8% |
| 182: Delete TCGA | MZKE181002A151A | NGS18017_G02 | 1% |
| 182: Delete TCGA | MZKE181002A151A | NGS18017_D03 | 6% |
| 182: Delete TCGA | MZKE181002A151A | NGS18017_G03 | 2% |
| 182: Delete TCGA | MZKE181002A151A | NGS18017_H03 | 2% |
| 182: Delete TCGA | MZKE181002A151A | NGS18017_E04 | 1% |
| 182: Delete TCGA | MZKE181002A151A | NGS18017_G04 | 1% |
| 182: Delete TCGA | MZKE181002A151A | NGS18017_E05 | 11% |
| 182: Delete TCGA | MZKE181002A151A | NGS18017_G05 | 1% |
| 182: Delete TCGA | MZKE181002A151A | NGS18017_H05 | 6% |
| 182: Delete TCGA | MZKE181002A151A | NGS18017_E06 | 1% |
| 182: Delete TCGA | MZKE181002A151A | NGS18017_E07 | 4% |
| 182: Delete TCGA | MZKE181002A151A | NGS18017_H07 | 36% |
| 182: Delete TCGA | MZKE181002A151A | NGS18017_E08 | 10% |
| 182: Delete TCGA | MZKE181002A151A | NGS18017_E09 | 3% |
| 182: Delete TCGA | MZKE181002A151A | NGS18017_H09 | 36% |
| 182: Delete TCGA | MZKE181002A151A | NGS18017_F10 | 4% |
| 182: Delete TCGA | MZKE181002A151A | NGS18017_H11 | 35% |

Table 8 shows sequencing information for 182: Delete TCGA for two events.

TABLE 9

| 182: Delete TCGA | MZKE181002A045A | | | | | MZKE181002A151A | | | | | | |
|---|---|---|---|---|---|---|---|---|---|---|---|---|
| | Central | Side1 | Side2 | Side3 | Side4 | Central | Side1 | Side2 | Side3 | Side4 | Side5 | Side6 |
| Top | | | | | | 2% | | | | | | |
| | 3% | | | | | | | | | | | |
| | 25% | | | | | | | | | | | |
| | 26% | | | | | 1% | | | | | | |
| | | | | | | 11% | | | | | | |
| | 32% | | | | | 1% | | | | | | |
| | | | | | 1% | 4% | | | 1% | | | 36% |
| | | | | 1% | | 10% | 8% | 1% | | | | |
| | 29% | | | | | 3% | | 2% | | | 2% | 36% |
| | | | | | | | | 1% | | | | |
| | | | | | 1% | | | 1% | | | 6% | 35% |
| Bottom | | | | | | | | | | | | |

Table 9. Tassel map for the allele (or edit) "Delete TCGA": the cells represent the spikelet sample positions on the tassel which contained that edit, and the percentage of that edit among all of the NGS reads for those samples, for two events Table 9 is a tassel map with the same information as was shown in table 8. Edit 182: Delete TCGA was found in multiple locations over different parts of the tassel including the central spike and side branches for two events. The % in each cell indicates the fraction of reads that had that sequence and corresponds to one well of a 96 well plate. Each well is a different tassel spikelet. Each well also had other diverse edits which appear in other tassel maps not shown here. This mutation comes up in different locations on the tassel, but some of the adjacent sections in the central spike of both events are likely showing sectors that are derived from the same single editing event earlier in plant or tassel development. To standardize the process across all events and constructs and therefore be able to compare which constructs are acting as optimal FMOS promoters, we set the following rules: Examining the tassel map, starting from the bottom of each spike, the first mutation was always counted as a unique mutation. Moving upwards from the first mutation, other mutations only counted if either, the mutation abundance was less than 10% or if the mutation abundance differed by more than 15% from the previous spikelet. In other words, the first edit found in a given column (and in the tassel maps, a column represents a tassel branch or the central spike) is counted; subsequent edits are counted as well, unless there is the same edit represented in the preceding cell with a percentage representation within +/−15% in the NGS data between those two samples (this is based on the idea that such edits with similar abundances are more likely to be a part of a continuous sector). Edits with <10% representation are excluded from the 15% rule because their rarity suggests they are not a part of a continuous sector. Using this rubric, the edits shown in bold italics in Table 9 were considered not to be independent of the previous edit and so were not counted. For this sequence mutation in Table 9, seven independent edits were identified for MSKE181002A045A and 17 for MZKE181002A151A.

For each event, the total number of independent edits was calculated (across all edits), and the resulting value was divided by the total number of samples evaluated by NGS (generally, there were 12 samples for the central spike plus 6 for each side branch, but the total differed for different events). This calculation gives us the average number of independent edits per spikelet sampled and is considered the 'mosaicism score'. For the constitutive promoter CMP, where there are only one (homozygous) or two (biallelic) edits detected in the entire tassel, the mosaicism score of an event that was sampled between 24 and 48 times would come out to be somewhere in the range of 0.021-0.083. With respect to the FMOS promoters, a first pass analysis revealed a few events that had no editing indicated in the pollen ADH1 assay, and also only had a few or no edits in the NGS data—these were likely events where there was near total silencing of transgene expression—and gave extremely low mosaicism scores (0.0-0.1). Removing these events from the analysis (MZKE181800A021A, MZKE181800A056A, MZKE181800A074A, MZKE182000A005A, MZKE182000A029A, MZKE182000A031A) the mosaicism score of the five FMOS promoters that we evaluated by NGS ranged between 1.24 (prZmAgo18A-01, construct #24269) and 11.79 (prZmBde1-02, construct #24230). Thus, by this conservative analysis, these FMOS promoters displayed roughly 15-fold (1.24/0.083) to 561-fold (11.79/0.021) higher mosaicism than ubiquitous promoters are capable of. This is most certainly an underestimate, given that not all of the tassel and ear was sampled for NGS. Again, here floral mosaicism is defined as the number or frequency of distinct (diverse) edits in the reproductive cells of an event: these higher mosaicism scores clearly indicate a high diversity of edits in the tassel, and thus higher FMOS promoter activity. Again, the mosaicism score represents the number of distinct edits detected on average within a spikelet sample.

Figure 26B:
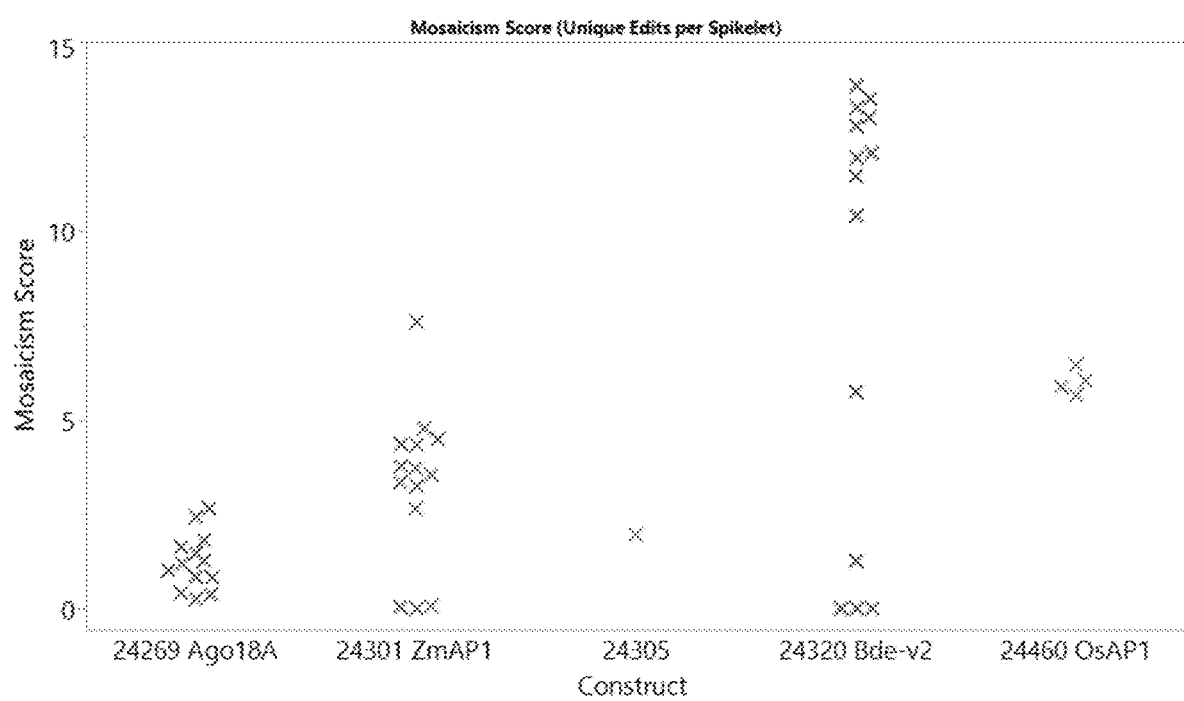
FIG. 26b is a graph showing mosaicism scores for five constructs.
Figure 26C:
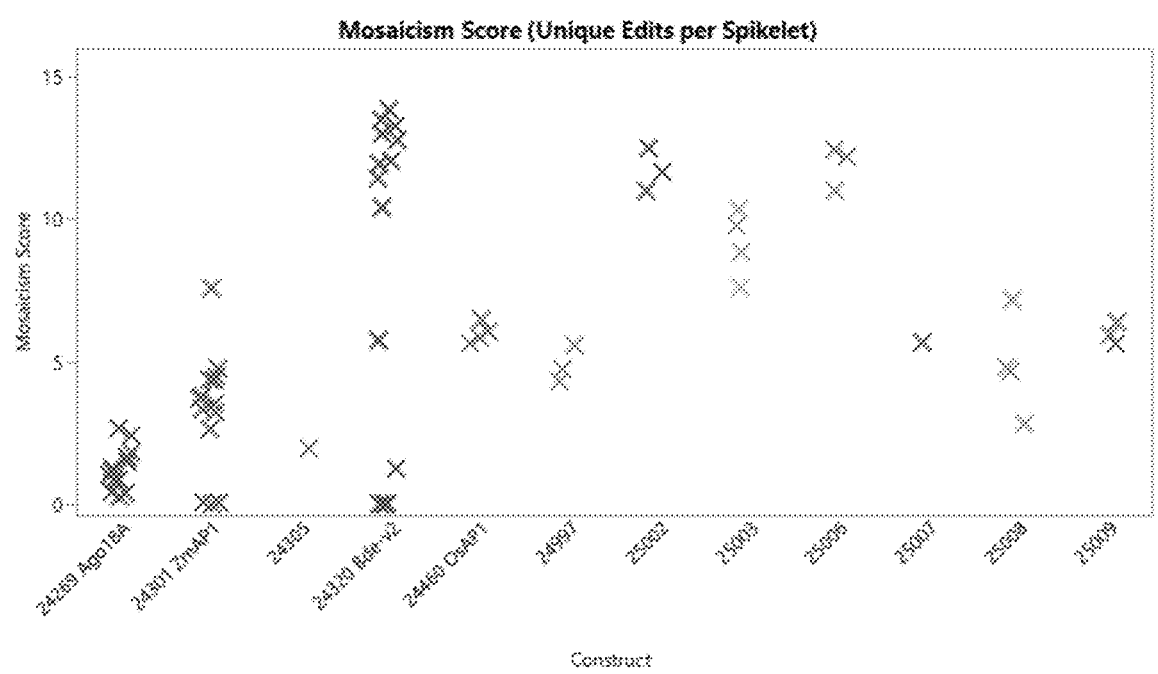
FIG. 26c is a graph comparing mosaicism scores of the shortened promoter constructs to the other constructs.

FIG. 26b shows the mosaicism scores for each of the five constructs for which we evaluated NGS data. Table 10 shows mosaicism scores of events from exemplary FMOS promoters, based on NGS data.

TABLE 10

| Construct | Event | Mosaicism Score |
|---|---|---|
| 24269 Ago18A | MZKE181002A003A | 0.83 |
| 24269 Ago18A | MZKE181002A015A | 1.79 |
| 24269 Ago18A | MZKE181002A017A | 1.25 |
| 24269 Ago18A | MZKE181002A040A | 0.25 |
| 24269 Ago18A | MZKE181002A061A | 0.38 |
| 24269 Ago18A | MZKE181002A080A | 2.42 |
| 24269 Ago18A | MZKE181002A088A | 1.63 |
| 24269 Ago18A | MZKE181002A097A | 0.83 |
| 24269 Ago18A | MZKE181002A121A | 1.00 |
| 24269 Ago18A | MZKE181002A139A | 1.46 |
| 24269 Ago18A | MZKE181002A142A | 0.42 |
| 24269 Ago18A | MZKE181002A045A | 1.17 |
| 24269 Ago18A | MZKE181002A151A | 2.65 |
| 24301 ZmAP1 | MZKE181800A004A | 7.58 |
| 24301 ZmAP1 | MZKE181800A019A | 4.33 |
| 24301 ZmAP1 | MZKE181800A021A | 0.07 |
| 24301 ZmAP1 | MZKE181800A022A | 3.53 |
| 24301 ZmAP1 | MZKE181800A033A | 3.23 |
| 24301 ZmAP1 | MZKE181800A050A | 3.71 |
| 24301 ZmAP1 | MZKE181800A056A | 0.03 |
| 24301 ZmAP1 | MZKE181800A063A | 4.50 |
| 24301 ZmAP1 | MZKE181800A064A | 3.33 |
| 24301 ZmAP1 | MZKE181800A067A | 3.77 |
| 24301 ZmAP1 | MZKE181800A073A | 2.64 |
| 24301 ZmAP1 | MZKE181800A074A | 0.00 |
| 24301 ZmAP1 | MZKE181800A078A | 4.36 |
| 24301 ZmAP1 | MZKE181800A084A | 4.77 |
| 24305 | MZKE181900A049A | 1.95 |
| 24320 Bde-v2 | MZKE182000A002A | 10.40 |
| 24320 Bde-v2 | MZKE182000A005A | 1.25 |
| 24320 Bde-v2 | MZKE182000A006A | 13.00 |
| 24320 Bde-v2 | MZKE182000A019A | 11.44 |
| 24320 Bde-v2 | MZKE182000A028A | 12.06 |
| 24320 Bde-v2 | MZKE182000A029A | 0.00 |
| 24320 Bde-v2 | MZKE182000A031A | 0.00 |
| 24320 Bde-v2 | MZKE182000A033A | 0.00 |
| 24320 Bde-v2 | MZKE182000A045A | 12.77 |
| 24320 Bde-v2 | MZKE182000A055A | 11.93 |
| 24320 Bde-v2 | MZKE182000A057A | 13.27 |
| 24320 Bde-v2 | MZKE182000A063A | 5.74 |
| 24320 Bde-v2 | MZKE182000A064A | 13.83 |
| 24320 Bde-v2 | MZKE182000A080A | 13.50 |
| 24460 OsAP1 | MZKE184306A008A | 6.04 |
| 24460 OsAP1 | MZKE184306A014A | 5.86 |
| 24460 OsAP1 | MZKE184306A034A | 5.67 |
| 24460 OsAP1 | MZKE184306A060A | 6.47 |

FMOS activity was further confirmed by sequencing of T1 progeny seed: Up to 100 seed were germinated from each of five events of construct 24301, 24320, 24269, and 24460. Taqman assays indicted the zygosity of the target-site in ADH1. (Table 11)

TABLE 11

Table 9b. Taqman score summary from T1 offspring (pooled from five events) for four FMOS constructs. A Taqman score of 0 means both copies were edited; a 1 is heterozygous; a 2 is "WT/WT" or unedited.

|  | 24320 | | 24301 | | 24269 | | 24460 | |
|---|---|---|---|---|---|---|---|---|
| Total T1 plants | 244 | | 261 | | 370 | | 112 | |
| Taqman score 0 | 101 | 41% | 90 | 34% | 135 | 36% | 53 | 47% |
| Taqman score 1 | 125 | 51% | 171 | 66% | 174 | 47% | 57 | 51% |
| Taqman score 2 | 18 | 7% | 0 | 0% | 0 | 0% | 2 | 2% |

Total edited alleles in progeny were counted by adding the number of progeny with one copy of ADH1 edited to 2*(the number of progeny with two copies of ADH1 edited). The predicted number of edits coming from the male side were then subtracted (this was determined by multiplying the paternal editing rate [from Table 4] by the number of progeny plants sampled); then the difference between the total edited alleles from the predicted number of paternal edits for each construct was divided by the number of total progeny to give a proxy for maternal editing rate.

Using this method the maternal editing rate of 24301, 24320, 24269, and 24460 were found to be 61%, 73%, 62%, and 61% respectively. Other examples may have other editing rates e.g. at least 50%, at least 55%, at least 60%, at least 70%, at least 80%. Therefore, the prZmBde1-02 promoter in construct 24320 was the most effective at editing the female cells (in the ear), even though the prOsAP1-01 (24460) was the best at editing the male side (85% male editing rate in the tassel). To understand the diversity of edits found in the progeny, DNA was extracted from progeny either one or with both ADH1 alleles edited. Target site PCR products were sequenced. In most instances, chromatogram doublets were observed starting at the target site. To clarify the Sanger sequencing results, the Inference of CRISPR Edits (ICE) program (Synthego) distinguished the two alleles.

Table 12 and Table 13 illustrates the T0 pollen ADH1 staining and the sequencing results of 50 T1 progeny from vector 24269, event number MZKE181002A135A. This event did not show editing in the leaves and the ADH1 staining appeared to show good FMOS activity. We didn't perform the NGS sequencing, but checking the T1 progeny, most of the individuals were biallelic, with two different edits inherited from the maternal (egg cell) and paternal (pollen grain/sperm cell) flowers. In some instances, no edit was found or the edits inherited were the same, but this was the exception rather than the rule. This is just an example of hundreds and hundreds of similar results obtained from this promoter and the other FMOS regulatory systems tested.

TABLE 12

Pollen ADH1 staining data for event MZKE181002A135A (construct 24269)

| Row | 1 | 2 | 3 | 4 | 5 | 6 | 7 | 8 | 9 | 10 | 11 | 12 | Event | Leaf Taqman |
|---|---|---|---|---|---|---|---|---|---|---|---|---|---|---|
| A | 25 | 50 | 50 | 40 | 50 | 0 | 0 | 50 | 10 | 25 | 50 | 25 | GVG00884650 | 2 |
| B | 0 | 25 | 50 | 0 | 75 | 25 | 0 | 0 | 25 | 0 | 0 | 0 | (MZKE181002A135A) | |
| C | 25 | 25 | 50 | 50 | 50 | 25 | 75 | 25 | 75 | 50 | 50 | ND | | |
| D | 0 | 0 | 0 | 0 | 0 | 0 | 0 | 25 | 0 | 25 | 0 | 0 | | |

TABLE 13

| S | Read % | Edit | SEQ ID NO | Sequence |
|---|---|---|---|---|
| 1 | 0.495 | +1 | 103 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 1a | 0.429 | -17 | 104 | TGGGAGGCCGG--------------\|--- AGGAGGTGGAGGTAGCGCCTCCGCAGGCCATGGAGGTGCGCGTCAAGATCCTCTTCACC TCGCTCTGCCACACCGACGTCTACTTCTGGGAGGCCAAGGTATCTAATCAGCCATCCCATT TGTGATCTTTGTCAGTAGATATGATA |
| 2 | 0.492 | -1 | 105 | TGGGAGGCCGGCAAGCCACTGTCG- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 2a | 0.444 | +1 | 106 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 3 | 0.321 | 0 | 107 | TGGGAGGCCGGCAAGCCACTGTCGA\|TCGAGGAGGTGGAGGTAGCGCCTCCGCAGGCC ATGGAGGTGCGCGTCAAGATCCTCTTCACCTCGCTCTGCCACACCGACGTCTACTTCTGGG AGGCCAAGGTATCTAATCAGCCATCCCATTTGTGATCTTTGTCAGTAGATATGATA |
| 4 | 0.975 | +1 | 108 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 5 | 0.309 | -3 | 109 | TGGGAGGCCGGCAAGCCACTGT--- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 6 | 0.204 | -1 | 110 | TGGGAGGCCGGCAAGCCACTGTCG- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |

TABLE 13-continued

| S | Read % | Edit | SEQ ID NO | Sequence |
|---|---|---|---|---|
| 6a | 0.102 | -2 | 111 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 7 | 0.498 | +1 | 112 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 7a | 0.353 | -3 | 113 | TGGGAGGCCGGCAAGCCACTGTC--\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 8 | 0.948 | -4 | 114 | TGGGAGGCCGGCAAGCCACTGT---\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 9 | 0.975 | +1 | 115 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 10 | 0.418 | +1 | 116 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 10a | 0.550 | -6 | 117 | TGGGAGGCCGGCAAGCCACTGTCGA\|------AGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 12 | 0.536 | -2 | 118 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 12a | 0.298 | 0 | 119 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 13 | 0.988 | 0 | 189 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 14 | 0.480 | -1 | 120 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 14a | 0.473 | +1 | 121 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 15 | 1.000 | 0 | 122 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 16 | 0.369 | -8 | 123 | TGGGAGGCCGGCAAGCCACTGTCG-\|-------GGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 16a | 0.474 | -1 | 124 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 17 | 0.655 | -1 | 125 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 13-continued

| S | Read % | Edit | SEQ ID NO | Sequence |
|---|---|---|---|---|
| 17a | 0.345 | -1 | 126 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 19 | 0.399 | -1 | 127 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 19a | 0.337 | +1 | 128 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 19b | 0.229 | -1 | 129 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 20 | 0.991 | +1 | 130 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 21 | 0.466 | -2 | 131 | TGGGAGGCCGGCAAGCCACTGTCGA\|--GAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 21a | 0.465 | +1 | 132 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 22 | 0.454 | -27 | 133 | TGGGAGGCCGGCAAGCCACTGTCGA---------------\|------------TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 22a | 0.162 | -3 | 134 | TGGGAGGCCGGCAAGCCACTGTC--\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 23 | 0.469 | -2 | 135 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 23a | 0.352 | -1 | 136 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 23b | 0.145 | -1 | 137 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 24 | 0.470 | +1 | 138 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 24a | 0.321 | -1 | 139 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 24b | 0.158 | -1 | 140 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 25 | 0.466 | +1 | 141 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 13-continued

| S | Read % | Edit | SEQ ID NO | Sequence |
|---|---|---|---|---|
| 25a | 0.532 | -1 | 142 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 26 | 0.487 | +1 | 143 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 26 | 0.482 | 0 | 144 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 27 | 0.983 | +1 | 145 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 28 | 0.493 | -1 | 146 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 28a | 0.481 | -2 | 147 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 29 | 0.491 | -4 | 148 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 29a | 0.440 | -3 | 149 | TGGGAGGCCGGCAAGCCACTGTCGA\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 30 | 0.460 | +1 | 150 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 30a | 0.413 | -3 | 151 | TGGGAGGCCGGCAAGCCACTGTCG--\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 31 | 0.993 | -1 | 152 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 32 | 0.475 | +1 | 153 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 32a | 0.514 | -1 | 154 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 33 | 0.476 | -1 | 155 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 33a | 0.470 | +1 | 156 | TGGGAGGCCGGCAAGCCACTGTCGAn\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| 34 | 0.493 | -1 | 157 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 13-continued

| S | Read % | Edit | SEQ ID NO | Sequence |
|---|--------|------|-----------|----------|
| 34a | 0.452 | +1 | 158 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 35 | 0.407 | +1 | 159 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 35a | 0.466 | -16 | 160 | TGGGAGGCCGGCAAGCCACTG----\|------------- AGGTAGCGCCTCCGCAGGCCATGGAGGTGCGCGTCAAGATCCTCTTCACCTCGCTCTGCC ACACCGACGTCTACTTCTGGGAGGCCAAGGTATCTAATCAGCCATCCCATTTGTGATCTTT GTCAGTAGATATGATA |
| 36 | 0.490 | -4 | 161 | TGGGAGGCCGGCAAGCCACTG---- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 36a | 0.470 | -1 | 162 | TGGGAGGCCGGCAAGCCACTGTCG- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 37 | 0.358 | +1 | 163 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 37a | 0.328 | -1 | 164 | TGGGAGGCCGGCAAGCCACTGTCG- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 38 | 0.470 | +1 | 165 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 38a | 0.391 | -3 | 166 | TGGGAGGCCGGCAAGCCACTGTC--\|- CGAGGAGGTGGAGGTAGCGCCTCCGCAGGCCATGGAGGTGCGCGTCAAGATCCTCTTCA CCTCGCTCTGCCACACCGACGTCTACTTCTGGGAGGCCAAGGTATCTAATCAGCCATCCCA TTTGTGATCTTTGTCAGTAGATATGATA |
| 39 | 0.487 | +1 | 167 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 39a | 0.481 | 0 | 168 | TGGGAGGCCGGCAAGCCACTGTCGA\|TCGAGGAGGTGGAGGTAGCGCCTCCGCAGGCC ATGGAGGTGCGCGTCAAGATCCTCTTCACCTCGCTCTGCCACACCGACGTCTACTTCTGGG AGGCCAAGGTATCTAATCAGCCATCCCATTTGTGATCTTTGTCAGTAGATATGATA |
| 40 | 0.470 | -2 | 169 | TGGGAGGCCGGCAAGCCACTGTC-- \|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 40a | 0.516 | -1 | 170 | TGGGAGGCCGGCAAGCCACTGTCGA\|- CGAGGAGGTGGAGGTAGCGCCTCCGCAGGCCATGGAGGTGCGCGTCAAGATCCTCTTCA CCTCGCTCTGCCACACCGACGTCTACTTCTGGGAGGCCAAGGTATCTAATCAGCCATCCCA TTTGTGATCTTTGTCAGTAGATATGATA |
| 41 | 0.955 | +1 | 171 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 42 | 0.486 | 0 | 172 | TGGGAGGCCGGCAAGCCACTGTCGA\|TCGAGGAGGTGGAGGTAGCGCCTCCGCAGGCC ATGGAGGTGCGCGTCAAGATCCTCTTCACCTCGCTCTGCCACACCGACGTCTACTTCTGGG AGGCCAAGGTATCTAATCAGCCATCCCATTTGTGATCTTTGTCAGTAGATATGATA |
| 42a | 0.483 | +1 | 173 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 43 | 0.998 | -1 | 174 | TGGGAGGCCGGCAAGCCACTGTCGA\|- CGAGGAGGTGGAGGTAGCGCCTCCGCAGGCCATGGAGGTGCGCGTCAAGATCCTCTTCA CCTCGCTCTGCCACACCGACGTCTACTTCTGGGAGGCCAAGGTATCTAATCAGCCATCCCA TTTGTGATCTTTGTCAGTAGATATGATA |

TABLE 13-continued

| S | Read % | Edit | SEQ ID NO | Sequence |
|---|---|---|---|---|
| 44 | 0.487 | -1 | 175 | TGGGAGGCCGGCAAGCCACTGTCG-\|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 44a | 0.459 | -4 | 176 | TGGGAGGCCGGCAAGCCACTG----\|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 45 | 0.457 | -2 | 177 | TGGGAGGCCGGCAAGCCACTGTC--\|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 45a | 0.505 | -4 | 178 | TGGGAGGCCGGCAAGCCACTG----\|TCGAGGAGGTGGAGGTAGCGCCTCCGCAGGCCATGGAGGTGCGCGTCAAGATCCTCTT CACCTCGCTCTGCCACACCGACGTCTACTTCTGGGAGGCCAAGGTATCTAATCAGCCATCC CATTTGTGATCTTTGTCAGTAGATATGATA |
| 46 | 0.996 | 0 | 179 | TGGGAGGCCGGCAAGCCACTGTCGA\|TCGAGGAGGTGGAGGTAGCGCCTCCGCAGGCC ATGGAGGTGCGCGTCAAGATCCTCTTCACCTCGCTCTGCCACACCGACGTCTACTTCTGGG AGGCCAAGGTATCTAATCAGCCATCCCATTTGTGATCTTTGTCAGTAGATATGATA |
| 47 | 0.409 | +1 | 180 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 47a | 0.347 | -15 | 181 | TGGGAGGCCGGCA------------\|--- AGGAGGTGGAGGTAGCGCCTCCGCAGGCCATGGAGGTGCGCGTCAAGATCCTCTTCACC TCGCTCTGCCACACCGACGTCTACTTCTGGGAGGCCAAGGTATCTAATCAGCCATCCCATT TGTGATCTTTGTCAGTAGATATGATA |
| 48 | 0.983 | +1 | 182 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 49 | 0.428 | +1 | 183 | TGGGAGGCCGGCAAGCCACTGTCGAn\|TCGAGGAGGTGGAGGTAGCGCCTCCGCAGGC CATGGAGGTGCGCGTCAAGATCCTCTTCACCTCGCTCTGCCACACCGACGTCTACTTCTGG GAGGCCAAGGTATCTAATCAGCCATCCCATTTGTGATCTTTGTCAGTAGATATGATA |
| 49a | 0.402 | -14 | 184 | TGGGAGGCCGGCAAGCC---------\|------ AGGTGGAGGTAGCGCCTCCGCAGGCCATGGAGGTGCGCGTCAAGATCCTCTTCACCTCG CTCTGCCACACCGACGTCTACTTCTGGGAGGCCAAGGTATCTAATCAGCCATCCCATTTGT GATCTTTGTCAGTAGATATGATA |
| 50 | 0.994 | 0 | 185 | TGGGAGGCCGGCAAGCCACTGTCGA\|TCGAGGAGGTGGAGGTAGCGCCTCCGCAGGCC ATGGAGGTGCGCGTCAAGATCCTCTTCACCTCGCTCTGCCACACCGACGTCTACTTCTGGG AGGCCAAGGTATCTAATCAGCCATCCCATTTGTGATCTTTGTCAGTAGATATGATA |

S = sample #

Table 14 illustrates the sequencing results of T1 progeny from vector 24301, event numbers MZKE18100A050A, MZKE18100A063A, MZKE18100A064A, MZKE18100A078A and MZKE18100A084A. Most of the individuals were biallelic, with two different edits inherited from the maternal (egg cell) and paternal (pollen grain/sperm cell) flowers. In a few instances, no edit was found or the edits inherited were the same.

TABLE 14

| Pedigree | S # | Read % | Edit | SEQ ID NO: | Sequence |
|---|---|---|---|---|---|
| MZKE18 1800A0 50A:- | 1a | 0.455 | -7 | 190 | TGGGAGGCCGGCAAGCCA-------\|TCGAGGAGGTGGAGGTAGCGCCTCCGCAGGCCATGGAGGTGCGCG TCAAGATCCTCTTCACCTCGCTCTGCCACACCGACGTCTACTTCTGGGA GGCCAAGGTATCTAATCAGCCATCCCATTTGTGATCTTTGTCAGTAGA TATGATAC |
| MZKE18 1800A0 50A:- | 1b | 0.453 | -2 | 191 | TGGGAGGCCGGCAAGCCACTGTC--\|TCGAGGAGGTGGAGGTAGCGCCTCCGCAGGCCATGGAGGTGCGCG TCAAGATCCTCTTCACCTCGCTCTGCCACACCGACGTCTACTTCTGGGA GGCCAAGGTATCTAATCAGCCATCCCATTTGTGATCTTTGTCAGTAGA TATGATAC |

TABLE 14-continued

| Pedigree | S # | Read % | Edit | SEQ ID NO: | Sequence |
|---|---|---|---|---|---|
| MZKE18 1800A0 50A:- | 2a | 0.409 | -2 | 192 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 2b | 0.490 | -6 | 193 | TGGGAGGCCGGCAAGCCAC------\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 3 | 0.969 | -2 | 194 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 4a | 0.462 | -15 | 195 | TGGGAGGCCGGCAAGCCAC------\|---------TGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 4b | 0.460 | -9 | 196 | TGGGAGGCCGGCAAGCC--------\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 5a | 0.336 | -29 | 197 | TGGGAGGCCGG--------------\|----------------TAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 5b | 0.354 | -2 | 198 | TGGGAGGCCGGCAAGCCACTGTCG-\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 6 | 0.967 | -1 | 199 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 7a | 0.377 | +1 | 200 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 50A:- | 7b | 0.482 | -6 | 201 | TGGGAGGCCGGCAAGCCACT-----\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 8a | 0.488 | -2 | 202 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 8b | 0.457 | -1 | 203 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 9a | 0.513 | -1 | 204 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

TABLE 14-continued

| Pedigree | S # | Read % | Edit | SEQ ID NO: | Sequence |
|---|---|---|---|---|---|
| MZKE18 1800A0 50A:- | 9b | 0.439 | -2 | 205 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 10 | 0.070 | -1 | 206 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 11a | 0.464 | -1 | 207 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 11b | 0.462 | -10 | 208 | TGGGAGGCCGGCAAGCCACTGT---\|-------GGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 12 | 0.070 | +1 | 209 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 50A:- | 13a | 0.473 | -2 | 210 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 13b | 0.488 | -1 | 211 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 14 | 0.070 | +1 | 212 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 50A:- | 15 | 0.976 | -1 | 213 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 16a | 0.500 | -6 | 214 | TGGGAGGCCGGCAAGCCAC------\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 16b | 0.390 | -1 | 215 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 17a | 0.487 | -2 | 216 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 17b | 0.452 | +1 | 217 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 | 18a | 0.520 | +1 | 218 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCT |

TABLE 14-continued

| Pedigree | S # | Read % | Edit | SEQ ID NO: | Sequence |
|---|---|---|---|---|---|
| 50A:- | | | | | CTGCCACACCGACGTCTACTTCTGGGAGGCCAAGGTATCTAATCAGCCATCCCATTTGTGATCTTTGTCAGTAGATATGATA |
| MZKE18 1800A0 50A:- | 18 b | 0.455 | -1 | 219 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 19 | 0.958 | -1 | 220 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 20a | 0.352 | +1 | 221 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 50A:- | 20b | 0.499 | -6 | 222 | TGGGAGGCCGGCAAGCCAC------\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 50A:- | 21 | 0.133 | +1 | 223 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 63A:- | 1a | 0.489 | +1 | 224 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 63A:- | 1b | 0.438 | -4 | 225 | TGGGAGGCCGGCAAGCCACTGTCG-\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 63A:- | 2a | 0.481 | +1 | 226 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 63A:- | 2b | 0.449 | -3 | 227 | TGGGAGGCCGGCAAGCCACTGT---\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 63A:- | 3 | 0.983 | +1 | 228 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 63A:- | 4a | 0.462 | +1 | 229 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 63A:- | 4b | 0.478 | -4 | 230 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 63A:- | 5a | 0.424 | +1 | 231 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 63A:- | 5b | 0.376 | -6 | 232 | TGGGAGGCCGGCAAGCCACTG----\|--GAGGAGGTGGAGGTAGCGCCTCCGCAGGCCATGGAGGTGCGCGTCAAGATCCTCTTCACCTCGCTCTGCCACACCGACGTCTACTTCTGGGAGG |

TABLE 14-continued

| Pedigree | S # | Read % | Edit | SEQ ID NO: | Sequence |
|---|---|---|---|---|---|
| | | | | | CCAAGGTATCTAATCAGCCATCCCATTTGTGATCTTTGTCAGTAGATAT GATAC |
| MZKE18 1800A0 63A:- | 6a | 0.486 | +1 | 233 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 63A:- | 6b | 0.440 | 3 | 234 | TGGGAGGCCGGCAAGCCACTGTCGA\|nnnTCGAGGAGGTGGAGGTA GCGCCTCCGCAGGCCATGGAGGTGCGCGTCAAGATCCTCTTCACCTC GCTCTGCCACACCGACGTCTACTTCTGGGAGGCCAAGGTATCTAATCA GCCATCCCATTTGTGATCTTTGTCAGTAGATATGA |
| MZKE18 1800A0 63A:- | 7a | 0.467 | 2 | 235 | TGGGAGGCCGGCAAGCCACTGTCGA\|nnTCGAGGAGGTGGAGGTAG CGCCTCCGCAGGCCATGGAGGTGCGCGTCAAGATCCTCTTCACCTCGC TCTGCCACACCGACGTCTACTTCTGGGAGGCCAAGGTATCTAATCAGC CATCCCATTTGTGATCTTTGTCAGTAGATATGAT |
| MZKE18 1800A0 63A:- | 7b | 0.462 | +1 | 236 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 63A:- | 8a | 0.457 | +1 | 237 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 63A:- | 8b | 0.476 | -4 | 238 | TGGGAGGCCGGCAAGCCACTGTCGA\|---- GGAGGTGGAGGTAGCGCCTCCGCAGGCCATGGAGGTGCGCGTCAAG ATCCTCTTCACCTCGCTCTGCCACACCGACGTCTACTTCTGGGAGGCCA AGGTATCTAATCAGCCATCCCATTTGTGATCTTTGTCAGTAGATATGAT AC |
| MZKE18 1800A0 64A:- | 1 | 0.977 | +1 | 239 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 64A:- | 2a | 0.480 | +1 | 240 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 64A:- | 2b | 0.451 | -4 | 241 | TGGGAGGCCGGCAAGCCACTG---- \|TCGAGGAGGTGGAGGTAGCGCCTCCGCAGGCCATGGAGGTGCGCG TCAAGATCCTCTTCACCTCGCTCTGCCACACCGACGTCTACTTCTGGGA GGCCAAGGTATCTAATCAGCCATCCCATTTGTGATCTTTGTCAGTAGA TATGATAC |
| MZKE18 1800A0 64A:- | 3a | 0.461 | +1 | 242 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 64A:- | 3b | 0.478 | -4 | 243 | TGGGAGGCCGGCAAGCCACTG---- \|TCGAGGAGGTGGAGGTAGCGCCTCCGCAGGCCATGGAGGTGCGCG TCAAGATCCTCTTCACCTCGCTCTGCCACACCGACGTCTACTTCTGGGA GGCCAAGGTATCTAATCAGCCATCCCATTTGTGATCTTTGTCAGTAGA TATGATAC |
| MZKE18 1800A0 64A:- | 4a | 0.481 | +1 | 244 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |
| MZKE18 1800A0 64A:- | 4b | 0.463 | -4 | 245 | TGGGAGGCCGGCAAGCCACTG---- \|TCGAGGAGGTGGAGGTAGCGCCTCCGCAGGCCATGGAGGTGCGCG TCAAGATCCTCTTCACCTCGCTCTGCCACACCGACGTCTACTTCTGGGA GGCCAAGGTATCTAATCAGCCATCCCATTTGTGATCTTTGTCAGTAGA TATGATAC |
| MZKE18 1800A0 64A:- | 5a | 0.473 | +1 | 246 | TGGGAGGCCGGCAAGCCACTGTCGA\|nTCGAGGAGGTGGAGGTAGC GCCTCCGCAGGCCATGGAGGTGCGCGTCAAGATCCTCTTCACCTCGCT CTGCCACACCGACGTCTACTTCTGGGAGGCCAAGGTATCTAATCAGCC ATCCCATTTGTGATCTTTGTCAGTAGATATGATA |

TABLE 14-continued

| Pedigree | S # | Read % | Edit | SEQ ID NO: | Sequence |
|---|---|---|---|---|---|
| MZKE18 1800A0 64A:- | 5b | 0.455 | -4 | 247 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 64A:- | 6a | 0.459 | +1 | 248 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 64A:- | 6b | 0.462 | -4 | 249 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 64A:- | 7a | 0.448 | +1 | 250 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 64A:- | 7b | 0.472 | -4 | 251 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 64A:- | 8a | 0.462 | +1 | 252 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 64A:- | 8b | 0.465 | -4 | 253 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 64A:- | 9a | 0.466 | +1 | 254 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 64A:- | 9b | 0.468 | -4 | 255 | TGGGAGGCCGGCAAGCCACTGTCG-\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 64A:- | 10a | 0.465 | +1 | 256 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 64A:- | 10b | 0.471 | -4 | 257 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 64A:- | 11a | 0.469 | +1 | 258 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 64A:- | 11b | 0.465 | -4 | 259 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 1a | 0.464 | -16 | 260 | TGGGAGGCCG---------------\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

TABLE 14-continued

| Pedigree | S # | Read % | Edit | SEQ ID NO: | Sequence |
|---|---|---|---|---|---|
| MZKE18 1800A0 78A:- | 1b | 0.444 | -4 | 261 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 2a | 0.446 | -2 | 262 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 2b | 0.477 | -6 | 263 | TGGGAGGCCGGCAAGCCACTGTCG-\|-----GAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 3a | 0.454 | -4 | 264 | TGGGAGGCCGGCAAGCCACTGT---\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 3b | 0.464 | -7 | 265 | TGGGAGGCCGGCAAGCCACTGT---\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 4a | 0.476 | -4 | 266 | TGGGAGGCCGGCAAGCCACTGTCG-\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 4b | 0.410 | -16 | 267 | TGGGAGGCCGGCAAGCCACTGT---\|-------------GGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 5a | 0.554 | -2 | 268 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 5b | 0.442 | -2 | 269 | TGGGAGGCCGGCAAGCCACTGTCGA\|--GAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 6a | 0.461 | -16 | 270 | TGGGAGGCCG---------------\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 6b | 0.397 | -3 | 271 | TGGGAGGCCGGCAAGCCACTGT---\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 7a | 0.464 | -4 | 272 | TGGGAGGCCGGCAAGCCACTGT---\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 7b | 0.470 | -6 | 273 | TGGGAGGCCGGCAAGCCACTGTC--\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

TABLE 14-continued

| Pedigree | S # | Read % | Edit | SEQ ID NO: | Sequence |
|---|---|---|---|---|---|
| MZKE18 1800A0 78A:- | 8a | 0.413 | -4 | 274 | TGGGAGGCCGGCAAGCCACTGTCGA\|----<br>GGAGGTGGAGGTAGCGCCTCCGCAGGCCATGGAGGTGCGCGTCAAG<br>ATCCTCTTCACCTCGCTCTGCCACACCGACGTCTACTTCTGGGAGGCCA<br>AGGTATCTAATCAGCCATCCCATTTGTGATCTTTGTCAGTAGATATGAT<br>AC |
| MZKE18 1800A0 78A:- | 8b | 0.467 | -5 | 275 | TGGGAGGCCGGCAAGCCACTGT---\|--<br>GAGGAGGTGGAGGTAGCGCCTCCGCAGGCCATGGAGGTGCGCGTCA<br>AGATCCTCTTCACCTCGCTCTGCCACACCGACGTCTACTTCTGGGAGG<br>CCAAGGTATCTAATCAGCCATCCCATTTGTGATCTTTGTCAGTAGATAT<br>GATAC |
| MZKE18 1800A0 78A:- | 9a | 0.424 | -4 | 276 | TGGGAGGCCGGCAAGCCACTG----<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 78A:- | 9b | 0.400 | -18 | 277 | TGGGAGGCCG---------------\|---<br>AGGAGGTGGAGGTAGCGCCTCCGCAGGCCATGGAGGTGCGCGTCAA<br>GATCCTCTTCACCTCGCTCTGCCACACCGACGTCTACTTCTGGGAGGC<br>CAAGGTATCTAATCAGCCATCCCATTTGTGATCTTTGTCAGTAGATATG<br>ATAC |
| MZKE18 1800A0 78A:- | 10a | 0.466 | -1 | 278 | TGGGAGGCCGGCAAGCCACTGTCGA\|-<br>CGAGGAGGTGGAGGTAGCGCCTCCGCAGGCCATGGAGGTGCGCGTC<br>AAGATCCTCTTCACCTCGCTCTGCCACACCGACGTCTACTTCTGGGAG<br>GCCAAGGTATCTAATCAGCCATCCCATTTGTGATCTTTGTCAGTAGAT<br>ATGATAC |
| MZKE18 1800A0 78A:- | 10b | 0.437 | -7 | 279 | TGGGAGGCCGGCAAGCCACTGTC--\|-----<br>GAGGTGGAGGTAGCGCCTCCGCAGGCCATGGAGGTGCGCGTCAAGA<br>TCCTCTTCACCTCGCTCTGCCACACCGACGTCTACTTCTGGGAGGCCAA<br>GGTATCTAATCAGCCATCCCATTTGTGATCTTTGTCAGTAGATATGATA<br>C |
| MZKE18 1800A0 78A:- | 11 | 0.832 | -7 | 280 | TGGGAGGCCGGCAAGCCACTGTCG-\|------<br>AGGTAGCGCCTCCGCAGGCCATGGAGGTGCGCGTCAAGAT<br>CCTCTTCACCTCGCTCTGCCACACCGACGTCTACTTCTGGGAGGCCAA<br>GGTATCTAATCAGCCATCCCATTTGTGATCTTTGTCAGTAGATATGATA<br>C |
| MZKE18 1800A0 78A:- | 12a | 0.459 | -4 | 281 | TGGGAGGCCGGCAAGCCACTG----<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 78A:- | 12b | 0.404 | -7 | 282 | TGGGAGGCCGGCAAGCCACTGT---\|----<br>GGAGGTGGAGGTAGCGCCTCCGCAGGCCATGGAGGTGCGCGTCAAG<br>ATCCTCTTCACCTCGCTCTGCCACACCGACGTCTACTTCTGGGAGGCCA<br>AGGTATCTAATCAGCCATCCCATTTGTGATCTTTGTCAGTAGATATGAT<br>AC |
| MZKE18 1800A0 78A:- | 13 | 0.980 | -2 | 283 | TGGGAGGCCGGCAAGCCACTGTC--<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 78A:- | 14a | 0.493 | +1 | 284 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18 1800A0 78A:- | 14b | 0.456 | -4 | 285 | TGGGAGGCCGGCAAGCCACTG----<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 78A:- | 15a | 0.456 | +1 | 286 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |

TABLE 14-continued

| Pedigree | S # | Read % | Edit | SEQ ID NO: | Sequence |
|---|---|---|---|---|---|
| MZKE18 1800A0 78A:- | 15b | 0.458 | -7 | 287 | TGGGAGGCCGGCAAGCCACTGTCG-\|------AGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 16a | 0.456 | +1 | 288 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 16b | 0.451 | -7 | 289 | TGGGAGGCCGGCAAGCCACTGT---\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 17a | 0.482 | +1 | 290 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 17b | 0.451 | -4 | 291 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 18a | 0.396 | -15 | 292 | TGGGAGGCCG---------------\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 18b | 0.394 | +1 | 293 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 19a | 0.471 | -16 | 294 | TGGGAGGCCG---------------\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 19b | 0.410 | +1 | 295 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 20a | 0.437 | +1 | 296 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 20b | 0.418 | -3 | 297 | TGGGAGGCCGGCAAGCCACTGT---\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 21a | 0.465 | +1 | 298 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 21b | 0.446 | 3 | 299 | TGGGAGGCCGGCAAGCCACTGTCGA\|nnnTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGA |
| MZKE18 1800A0 78A:- | 22 | 0.469 | +1 | 300 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 14-continued

| Pedigree | S # | Read % | Edit | SEQ ID NO: | Sequence |
|---|---|---|---|---|---|
| MZKE18 1800A0 78A:- | 23a | 0.498 | -1 | 301 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 23b | 0.430 | -7 | 302 | TGGGAGGCCGGCAAGCCACTGT---\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 24 | 0.951 | +1 | 303 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 25a a | 0.518 | +1 | 304 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 25b | 0.355 | -3 | 305 | TGGGAGGCCGGCAAGCCACTGT---\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 26 | 0.464 | +1 | 306 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 26b | 0.454 | -4 | 307 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 27a | 0.490 | -2 | 308 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 27b | 0.452 | +1 | 309 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 28a | 0.475 | +1 | 310 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 28b | 0.449 | -4 | 311 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 78A:- | 29a | 0.419 | +1 | 312 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 78A:- | 29b | 0.478 | -7 | 313 | TGGGAGGCCGGCAAGCCACTGT---\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 84A:- | 1 | 0.998 | -10 | 314 | TGGGAGGCCGGCAAGCCACTGT---\|-------GGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

TABLE 14-continued

| Pedigree | S # | Read % | Edit | SEQ ID NO: | Sequence |
|---|---|---|---|---|---|
| MZKE18 1800A0 84A:- | 2a | 0.378 | -16 | 315 | TGGGAGGCCGGCAAGCCACTGT---\|-------------<br>GGTAGCGCCTCCGCAGGCCATGGAGGTGCGCGTCAAGATCCTCTTCA<br>CCTCGCTCTGCCACACCGACGTCTACTTCTGGGAGGCCAAGGTATCTA<br>ATCAGCCATCCCATTTGTGATCTTTGTCAGTAGATATGATAC |
| MZKE18 1800A0 84A:- | 2b | 0.410 | -10 | 316 | TGGGAGGCCGGCAAGCCACTGTCGA\|----------<br>GGAGGTAGCGCCTCCGCAGGCCATGGAGGTGCGCGTCAAGATCCTCT<br>TCACCTCGCTCTGCCACACCGACGTCTACTTCTGGGAGGCCAAGGTAT<br>CTAATCAGCCATCCCATTTGTGATCTTTGTCAGTAGATATGATAC |
| MZKE18 1800A0 84A:- | 3a | 0.468 | -4 | 317 | TGGGAGGCCGGCAAGCCACTG----<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 84A:- | 3b | 0.485 | -9 | 318 | TGGGAGGCCGGCAAGC---------<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 84A:- | 4 | 0.988 | -14 | 319 | TGGGAGGCCGGCAA-----------\|---<br>AGGAGGTGGAGGTAGCGCCTCCGCAGGCCATGGAGGTGCGCGTCAA<br>GATCCTCTTCACCTCGCTCTGCCACACCGACGTCTACTTCTGGGAGGC<br>CAAGGTATCTAATCAGCCATCCCATTTGTGATCTTTGTCAGTAGATATG<br>ATAC |
| MZKE18 1800A0 84A:- | 5a | 0.479 | -1 | 320 | TGGGAGGCCGGCAAGCCACTGTCG-<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 84A:- | 5b | 0.470 | -2 | 321 | TGGGAGGCCGGCAAGCCACTGTC--<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 84A:- | 6a | 0.443 | +5 | 322 | TGGGAGGCCGGCAAGCCACTGTCGA\|nnnnnTCGAGGAGGTGGAGG<br>TAGCGCGCCTCCGCAGGCCATGGAGGTGCGCGTCAAGATCCTCTTCACCT<br>CGCTCTGCCACACCGACGTCTACTTCTGGGAGGCCAAGGTATCTAATC<br>AGCCATCCCATTTGTGATCTTTGTCAGTAGATAT |
| MZKE18 1800A0 84A:- | 6b | 0.416 | -1 | 323 | TGGGAGGCCGGCAAGCCACTGTCG-<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 84A:- | 7a | 0.482 | -3 | 324 | TGGGAGGCCGGCAAGCCACTGT---<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18 1800A0 84A:- | 7b | 0.398 | -5 | 325 | TGGGAGGCCGGCAAGCCACTGTC--\|---<br>AGGAGGTGGAGGTAGCGCCTCCGCAGGCCATGGAGGTGCGCGTCAA<br>GATCCTCTTCACCTCGCTCTGCCACACCGACGTCTACTTCTGGGAGGC<br>CAAGGTATCTAATCAGCCATCCCATTTGTGATCTTTGTCAGTAGATATG<br>ATAC |
| MZKE18 1800A0 84A:- | 8a | 0.444 | -21 | 326 | TGGGAGGCCG---------------\|------<br>AGGTGGAGGTAGCGCCTCCGCAGGCCATGGAGGTGCGCGTCAAGAT<br>CCTCTTCACCTCGCTCTGCCACACCGACGTCTACTTCTGGGAGGCCAA<br>GGTATCTAATCAGCCATCCCATTTGTGATCTTTGTCAGTAGATATGATA<br>C |
| MZKE18 1800A0 84A:- | 8b | 0.393 | -15 | 327 | TGGGAGGCCGGCAAGCCA-------\|--------<br>GTGGAGGTAGCGCCTCCGCAGGCCATGGAGGTGCGCGTCAAGATCCT<br>CTTCACCTCGCTCTGCCACACCGACGTCTACTTCTGGGAGGCCAAGGT<br>ATCTAATCAGCCATCCCATTTGTGATCTTTGTCAGTAGATATGATAC |
| MZKE18 1800A0 | 9a | 0.463 | -2 | 328 | TGGGAGGCCGGCAAGCCACTGTCGA\|--<br>GAGGAGGTGGAGGTAGCGCCTCCGCAGGCCATGGAGGTGCGCGTCA |

TABLE 14-continued

| Pedigree | S # | Read % | Edit | SEQ ID NO: | Sequence |
|---|---|---|---|---|---|
| 84A:- | | | | | AGATCCTCTTCACCTCGCTCTGCCACACCGACGTCTACTTCTGGGAGG<br>CCAAGGTATCTAATCAGCCATCCCATTTGTGATCTTTGTCAGTAGATAT<br>GATAC |
| MZKE18<br>1800A0<br>84A:- | 9b | 0.486 | -1 | 329 | TGGGAGGCCGGCAAGCCACTGTCG-<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18<br>1800A0<br>84A:- | 10a | 0.106 | -9 | 330 | TGGGAGGCCGGCAAGCCACTGTCGA\|---------<br>TGGAGGTAGCGCCTCCGCAGGCCATGGAGGTGCGCGTCAAGATCCTC<br>TTCACCTCGCTCTGCCACACCGACGTCTACTTCTGGGAGGCCAAGGTA<br>TCTAATCAGCCATCCCATTTGTGATCTTTGTCAGTAGATATGATAC |
| MZKE18<br>1800A0<br>84A:- | 10b | 0.199 | +1 | 331 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18<br>1800A0<br>84A:- | 11a | 0.477 | +1 | 332 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18<br>1800A0<br>84A:- | 11b | 0.437 | -9 | 333 | TGGGAGGCCGGCAAGCCACTGTC--\|-------<br>GGTGGAGGTAGCGCCTCCGCAGGCCATGGAGGTGCGCGTCAAGATC<br>CTCTTCACCTCGCTCTGCCACACCGACGTCTACTTCTGGGAGGCCAAG<br>GTATCTAATCAGCCATCCCATTTGTGATCTTTGTCAGTAGATATGATAC |
| MZKE18<br>1800A0<br>84A:- | 12a | 0.425 | +5 | 334 | TGGGAGGCCGGCAAGCCACTGTCGA\|nnnnnTCGAGGAGGTGGAGG<br>TAGCGCCTCCGCAGGCCATGGAGGTGCGCGTCAAGATCCTCTTCACCT<br>CGCTCTGCCACACCGACGTCTACTTCTGGGAGGCCAAGGTATCTAATC<br>AGCCATCCCATTTGTGATCTTTGTCAGTAGATAT |
| MZKE18<br>1800A0<br>84A:- | 12b | 0.374 | +1 | 335 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18<br>1800A0<br>84A:- | 13a | 0.513 | +1 | 336 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18<br>1800A0<br>84A:- | 13b | 0.420 | -10 | 337 | TGGGAGGCCGGCAAGCCACTGT---\|-------<br>GGTGGAGGTAGCGCCTCCGCAGGCCATGGAGGTGCGCGTCAAGATC<br>CTCTTCACCTCGCTCTGCCACACCGACGTCTACTTCTGGGAGGCCAAG<br>GTATCTAATCAGCCATCCCATTTGTGATCTTTGTCAGTAGATATGATAC |
| MZKE18<br>1800A0<br>84A:- | 14a | 0.488 | +1 | 338 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18<br>1800A0<br>84A:- | 14b | 0.462 | -2 | 339 | TGGGAGGCCGGCAAGCCACTGTC--<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |
| MZKE18<br>1800A0<br>84A:- | 15a | 0.394 | +1 | 340 | TGGGAGGCCGGCAAGCCACTGTCGA\|nTCGAGGAGGTGGAGGTAGC<br>GCCTCCGCAGGCCATGGAGGTGCGCGTCAAGATCCTCTTCACCTCGCT<br>CTGCCACACCGACGTCTACTTCTGGGAGGCCAAGGTATCTAATCAGCC<br>ATCCCATTTGTGATCTTTGTCAGTAGATATGATA |
| MZKE18<br>1800A0<br>84A:- | 15b | 0.369 | +8 | 341 | TGGGAGGCCGGCAAGCCACTGTCGA\|nnnnnnnTCGAGGAGGTGGA<br>GGTAGCGCCTCCGCAGGCCATGGAGGTGCGCGTCAAGATCCTCTTCA<br>CCTCGCTCTGCCACACCGACGTCTACTTCTGGGAGGCCAAGGTATCTA<br>ATCAGCCATCCCATTTGTGATCTTTGTCAGTAGA |
| MZKE18<br>1800A0<br>84A:- | 16a | 0.509 | -4 | 342 | TGGGAGGCCGGCAAGCCACTG----<br>\|TCGAGGAGGTGGAGGTAGCGCCTCCGCAGGCCATGGAGGTGCGCG<br>TCAAGATCCTCTTCACCTCGCTCTGCCACACCGACGTCTACTTCTGGGA<br>GGCCAAGGTATCTAATCAGCCATCCCATTTGTGATCTTTGTCAGTAGA<br>TATGATAC |

TABLE 14-continued

| Pedigree | S# | Read % | Edit | SEQ ID NO: | Sequence |
|---|---|---|---|---|---|
| MZKE18 1800A0 84A:- | 16b | 0.404 | -10 | 343 | TGGGAGGCCGGCAAGCCACTGT---\|-------GGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 84A:- | 17a | 0.461 | +5 | 344 | TGGGAGGCCGGCAAGCCACTGTCGA\|nnnnnTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATAT |
| MZKE18 1800A0 84A:- | 17b | 0.410 | -1 | 345 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE18 1800A0 84A:- | 18 | 0.085 | +1 | 346 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 84A:- | 19a | 0.481 | +1 | 347 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE18 1800A0 84A:- | 19b | 0.440 | -10 | 348 | TGGGAGGCCGGCAAGCCACTGT---\|-------GGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

S# = Sample #

Table 15 illustrates the sequencing results of T1 progeny from vector 24320, event numbers MZKE18200A019A, MZKE18200A028A, MZKE18200A045A, MZKE18200A057A and MZKE18200A064A. Most of the individuals were biallelic, with two different edits inherited from the maternal (egg cell) and paternal (pollen grain/sperm cell) flowers. In some instances, no edit was found or the edits inherited were the same.

TABLE 15

| Ped. | Sample | Read % | Edit | SEQ ID NO: | Sequence |
|---|---|---|---|---|---|
| MZKE 1820 00A0 19A:- | 1a | 0.475 | +1 | 349 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 19A:- | 1b | 0.458 | -3 | 350 | TGGGAGGCCGGCAAGCCACTGT---\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 2a | 0.529 | -24 | 351 | TGGGAGGCCG---------------\|---------TGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 2b | 0.349 | -4 | 352 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 3a | 0.582 | -4 | 353 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 3b | 0.052 | +1 | 354 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 15-continued

| Ped. | Sample | Read % | Edit | SEQ ID NO: | Sequence |
|---|---|---|---|---|---|
| MZKE 1820 00A0 19A:- | 4a | 0.468 | +1 | 355 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 19A:- | 4b | 0.475 | -4 | 356 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 5a | 0.469 | +1 | 357 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 19A:- | 5b | 0.463 | -4 | 358 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 6a | 0.463 | -4 | 359 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 6b | 0.458 | -3 | 360 | TGGGAGGCCGGCAAGCCACTGTC\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 7a | 0.488 | -1 | 361 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 7b | 0.464 | -4 | 362 | TGGGAGGCCGGCAAGCCACTGTCG-\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 8 | 0.955 | -4 | 363 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 9a | 0.490 | +1 | 364 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 19A:- | 9b | 0.449 | -2 | 365 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 19A:- | 10 | 0.454 | +1 | 366 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 19A:- | 11 | 0.990 | +1 | 367 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 15-continued

| Ped. | Sample | Read % | Edit | SEQ ID NO: | Sequence |
|---|---|---|---|---|---|
| MZKE 1820 00A0 19A:- | 12a | 0.475 | +1 | 368 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 19A:- | 12b | 0.434 | WT | 369 | TGGGAGGCCGGCAAGCCACTGTCGA\|TCGAGGAGGTGGAGGTAGC GCCTCCGCAGGCCATGGAGGTGCGCGTCAAGATCCTCTTCACCTCGC TCTGCCACACCGACGTCTACTTCTGGGAGGCCAAGGTATCTAATCAG CCATCCCATTTGTGATCTTTGTCAGTAGATATGATAC |
| MZKE 1820 00A0 19A:- | 13a | 0.474 | +1 | 370 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 19A:- | 13b | 0.301 | -1 | 371 | TGGGAGGCCGGCAAGCCACTGTCGA\|-CGAGGAGGTGGAGGTAGCGCCTCCGCAGGCCATGGAGGTGCGCGT CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE 1820 00A0 19A:- | 14 | 0.181 | -1 | 372 | TGGGAGGCCGGCAAGCCACTGTCG-\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 19A:- | 15a | 0.494 | +1 | 373 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 19A:- | 15b | 0.449 | -4 | 374 | TGGGAGGCCGGCAAGCCACTG----\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 19A:- | 16a | 0.484 | +2 | 375 | TGGGAGGCCGGCAAGCCACTGTCGA\|nnTCGAGGAGGTGGAGGTA GCGCCTCCGCAGGCCATGGAGGTGCGCGTCAAGATCCTCTTCACCTC GCTCTGCCACACCGACGTCTACTTCTGGGAGGCCAAGGTATCTAATC AGCCATCCCATTTGTGATCTTTGTCAGTAGATATGAT |
| MZKE 1820 00A0 19A:- | 16b | 0.452 | +1 | 376 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 19A:- | 17 | 0.996 | -1 | 377 | TGGGAGGCCGGCAAGCCACTGTCGA\|-CGAGGAGGTGGAGGTAGCGCCTCCGCAGGCCATGGAGGTGCGCGT CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE 1820 00A0 28A:- | 1a | 0.420 | -13 | 378 | TGGGAGGCCGGCAAGCC--------\|-----GAGGTGGAGGTAGCGCCTCCGCAGGCCATGGAGGTGCGCGTCAAG ATCCTCTTCACCTCGCTCTGCCACACCGACGTCTACTTCTGGGAGGCC AAGGTATCTAATCAGCCATCCCATTTGTGATCTTTGTCAGTAGATATG ATAC |
| MZKE 1820 00A0 28A:- | 1b | 0.367 | -3 | 379 | TGGGAGGCCGGCAAGCCACTGT---\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 28A:- | 2a | 0.530 | -19 | 380 | TGGGAGGCCGGCAAGCCA-------\|-------------AGGTAGCGCCTCCGCAGGCCATGGAGGTGCGCGTCAAGATCCTCTT CACCTCGCTCTGCCACACCGACGTCTACTTCTGGGAGGCCAAGGTAT CTAATCAGCCATCCCATTTGTGATCTTTGTCAGTAGATATGATAC |
| MZKE 1820 00A0 28A:- | 2b | 0.301 | -4 | 381 | TGGGAGGCCGGCAAGCCACTGTCGA\|----GGAGGTGGAGGTAGCGCCTCCGCAGGCCATGGAGGTGCGCGTCAA GATCCTCTTCACCTCGCTCTGCCACACCGACGTCTACTTCTGGGAGGC CAAGGTATCTAATCAGCCATCCCATTTGTGATCTTTGTCAGTAGATAT GATAC |

TABLE 15-continued

| Ped. | Sample | Read % | Edit | SEQ ID NO: | Sequence |
|---|---|---|---|---|---|
| MZKE 1820 00A0 28A:- | 3a | 0.440 | -3 | 382 | TGGGAGGCCGGCAAGCCACTGTCGA\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 3b | 0.516 | -1 | 383 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 4a | 0.467 | +1 | 384 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 28A:- | 4b | 0.481 | -4 | 385 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 5 | 0.740 | -4 | 386 | TGGGAGGCCGGCAAGCCACTGTCG-\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 6a | 0.446 | -27 | 387 | TGGGAGGCCG---------------\|------------AGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 6b | 0.361 | +1 | 388 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 28A:- | 7a | 0.458 | -3 | 389 | TGGGAGGCCGGCAAGCCACTGT---\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 7b | 0.437 | +1 | 390 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 28A:- | 8a | 0.403 | +1 | 391 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 28A:- | 8b | 0.413 | -1 | 392 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 9a | 0.577 | -2 | 393 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 28A:- | 9b | 0.365 | -2 | 394 | TGGGAGGCCGGCAAGCCACTGTCG-\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 | 10 | 0.860 | -4 | 395 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGG |

TABLE 15-continued

| Ped. | Sample | Read % | Edit | SEQ ID NO: | Sequence |
|---|---|---|---|---|---|
| 28A:- | | | | | GAGGCCAAGGTATCTAATCAGCCATCCCATTTGTGATCTTTGTCAGT AGATATGATAC |
| MZKE 1820 00A0 28A:- | 11a | 0.408 | -1 | 396 | TGGGAGGCCGGCAAGCCACTGTCG-\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 28A:- | 11b | 0.463 | -12 | 397 | TGGGAGGCCGGCAA-----------\|--CGAGGAGGTGGAGGTAGCGCCTCCGCAGGCCATGGAGGTGCGCGT CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE 1820 00A0 28A:- | 12a | 0.463 | +1 | 398 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 28A:- | 12b | 0.474 | -4 | 399 | TGGGAGGCCGGCAAGCCACTGTCGA\|----GGAGGTGGAGGTAGCGCCTCCGCAGGCCATGGAGGTGCGCGTCAA GATCCTCTTCACCTCGCTCTGCCACACCGACGTCTACTTCTGGGAGGC CAAGGTATCTAATCAGCCATCCCATTTGTGATCTTTGTCAGTAGATAT GATAC |
| MZKE 1820 00A0 28A:- | 13a | 0.378 | -19 | 400 | TGGGAGGCCGGCAAGCCACT-----\|---------------GTAGCGCCTCCGCAGGCCATGGAGGTGCGCGTCAAGATCCTCTTCA CCTCGCTCTGCCACACCGACGTCTACTTCTGGGAGGCCAAGGTATCT AATCAGCCATCCCATTTGTGATCTTTGTCAGTAGATATGATAC |
| MZKE 1820 00A0 28A:- | 13b | 0.356 | -27 | 401 | TGGGAGGCCG---------------\|-----------AGGTAGCGCCTCCGCAGGCCATGGAGGTGCGCGTCAAGATCCTCTT CACCTCGCTCTGCCACACCGACGTCTACTTCTGGGAGGCCAAGGTAT CTAATCAGCCATCCCATTTGTGATCTTTGTCAGTAGATATGATAC |
| MZKE 1820 00A0 28A:- | 14a | 0.462 | -26 | 402 | TGGGAGGCCG---------------\|-----------GAGGTAGCGCCTCCGCAGGCCATGGAGGTGCGCGTCAAGATCCTCT TCACCTCGCTCTGCCACACCGACGTCTACTTCTGGGAGGCCAAGGTA TCTAATCAGCCATCCCATTTGTGATCTTTGTCAGTAGATATGATAC |
| MZKE 1820 00A0 28A:- | 14b | 0.327 | -4 | 403 | TGGGAGGCCGGCAAGCCACTGTCGA\|----GGAGGTGGAGGTAGCGCCTCCGCAGGCCATGGAGGTGCGCGTCAA GATCCTCTTCACCTCGCTCTGCCACACCGACGTCTACTTCTGGGAGGC CAAGGTATCTAATCAGCCATCCCATTTGTGATCTTTGTCAGTAGATAT GATAC |
| MZKE 1820 00A0 28A:- | 15 | 0.965 | -1 | 404 | TGGGAGGCCGGCAAGCCACTGTCG-\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 28A:- | 16a | 0.436 | +1 | 405 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 28A:- | 16b | 0.434 | -10 | 406 | TGGGAGGCCGGCAAGCCACTG----\|------AGGTGGAGGTAGCGCCTCCGCAGGCCATGGAGGTGCGCGTCAAGA TCCTCTTCACCTCGCTCTGCCACACCGACGTCTACTTCTGGGAGGCCA AGGTATCTAATCAGCCATCCCATTTGTGATCTTTGTCAGTAGATATGA TAC |
| MZKE 1820 00A0 28A:- | 17a | 0.480 | +1 | 407 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 28A:- | 17b | 0.410 | -6 | 408 | TGGGAGGCCGGCAAGCCACTGTCG-\|-----GAGGTGGAGGTAGCGCCTCCGCAGGCCATGGAGGTGCGCGTCAAG ATCCTCTTCACCTCGCTCTGCCACACCGACGTCTACTTCTGGGAGGCC AAGGTATCTAATCAGCCATCCCATTTGTGATCTTTGTCAGTAGATATG ATAC |
| MZKE 1820 | 18a | 0.486 | +1 | 409 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG |

TABLE 15-continued

| Ped. | Sample | Read % | Edit | SEQ ID NO: | Sequence |
|---|---|---|---|---|---|
| MZKE1820 00A0 28A:- | | | | | CTCTGCCACACCGACGTCTACTTCTGGGAGGCCAAGGTATCTAATCA GCCATCCCATTTGTGATCTTTGTCAGTAGATATGATA |
| MZKE1820 00A0 28A:- | 18b | 0.464 | -2 | 410 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 28A:- | 19a | 0.471 | -27 | 411 | TGGGAGGCCG---------------\|------------AGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 28A:- | 19b | 0.361 | +1 | 412 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE1820 00A0 28A:- | 20a | 0.509 | +1 | 413 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE1820 00A0 28A:- | 20b | 0.439 | -2 | 414 | TGGGAGGCCGGCAAGCCACTGTCG-\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 28A:- | 21a | 0.508 | -27 | 415 | TGGGAGGCCG---------------\|------------AGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 28A:- | 21b | 0.316 | +1 | 416 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE1820 00A0 28A:- | 22a | 0.457 | -20 | 417 | TGGGAGGCCG---------------\|-----GAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 28A:- | 22b | 0.444 | +1 | 418 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE1820 00A0 28A:- | 23a | 0.473 | +1 | 419 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE1820 00A0 28A:- | 23b | 0.438 | -4 | 420 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 28A:- | 24a | 0.699 | +1 | 421 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE1820 00A0 28A:- | 24b | 0.222 | -1 | 422 | TGGGAGGCCGGCAAGCCACTGTC-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE1820 00A0 | 1a | 0.410 | -2 | 423 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGG |

TABLE 15-continued

| Ped. | Sample | Read % | Edit | SEQ ID NO: | Sequence |
|---|---|---|---|---|---|
| 45A:- | | | | | GAGGCCAAGGTATCTAATCAGCCATCCCATTTGTGATCTTTGTCAGT AGATATGATAC |
| MZKE 1820 00A0 45A:- | 1b | 0.476 | -14 | 424 | TGGGAGGCCGGCAAGCCACTGTC--\|------------ AGGTAGCGCCTCCGCAGGCCATGGAGGTGCGCGTCAAGATCCTCTT CACCTCGCTCTGCCACACCGACGTCTACTTCTGGGAGGCCAAGGTAT CTAATCAGCCATCCCATTTGTGATCTTTGTCAGTAGATATGATAC |
| MZKE 1820 00A0 45A:- | 2a | 0.492 | -2 | 425 | TGGGAGGCCGGCAAGCCACTGTC-- \|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 45A:- | 2b | 0.460 | +1 | 426 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 45A:- | 3a | 0.281 | -27 | 427 | TGGGAGGCCG---------------\|------------ AGGTAGCGCCTCCGCAGGCCATGGAGGTGCGCGTCAAGATCCTCTT CACCTCGCTCTGCCACACCGACGTCTACTTCTGGGAGGCCAAGGTAT CTAATCAGCCATCCCATTTGTGATCTTTGTCAGTAGATATGATAC |
| MZKE 1820 00A0 45A:- | 3b | 0.197 | -6 | 428 | TGGGAGGCCGGCAAGCCACTGTC--\|---- GGAGGTGGAGGTAGCGCCTCCGCAGGCCATGGAGGTGCGCGTCAA GATCCTCTTCACCTCGCTCTGCCACACCGACGTCTACTTCTGGGAGGC CAAGGTATCTAATCAGCCATCCCATTTGTGATCTTTGTCAGTAGATAT GATAC |
| MZKE 1820 00A0 45A:- | 4a | 0.374 | +4 | 429 | TGGGAGGCCGGCAAGCCACTGTCGA\|nnnnTCGAGGAGGTGGAGG TAGCGCCTCCGCAGGCCATGGAGGTGCGCGTCAAGATCCTCTTCACC TCGCTCTGCCACACCGACGTCTACTTCTGGGAGGCCAAGGTATCTAA TCAGCCATCCCATTTGTGATCTTTGTCAGTAGATATG |
| MZKE 1820 00A0 45A:- | 4b | 0.289 | +1 | 430 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 45A:- | 5a | 0.466 | -4 | 431 | TGGGAGGCCGGCAAGCCACTG---- \|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE 1820 00A0 45A:- | 5b | 0.411 | -11 | 432 | TGGGAGGCCGGCAAGCCA--------\|---- GGAGGTGGAGGTAGCGCCTCCGCAGGCCATGGAGGTGCGCGTCAA GATCCTCTTCACCTCGCTCTGCCACACCGACGTCTACTTCTGGGAGGC CAAGGTATCTAATCAGCCATCCCATTTGTGATCTTTGTCAGTAGATAT GATAC |
| MZKE 1820 00A0 45A:- | 6 | 0.967 | -4 | 433 | TGGGAGGCCGGCAAGCCACTGT---\|- CGAGGAGGTGGAGGTAGCGCCTCCGCAGGCCATGGAGGTGCGCGT CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE 1820 00A0 45A:- | 7a | 0.389 | +1 | 434 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE 1820 00A0 45A:- | 7b | 0.476 | -16 | 435 | TGGGAGGCCGGCAAGCCA-------\|--------- TGGAGGTAGCGCCTCCGCAGGCCATGGAGGTGCGCGTCAAGATCCT CTTCACCTCGCTCTGCCACACCGACGTCTACTTCTGGGAGGCCAAGG TATCTAATCAGCCATCCCATTTGTGATCTTTGTCAGTAGATATGATAC |
| MZKE 1820 00A0 45A:- | 8a | 0.402 | -4 | 436 | TGGGAGGCCGGCAAGCCACTG---- \|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |

TABLE 15-continued

| Ped. | Sample | Read % | Edit | SEQ ID NO: | Sequence |
|---|---|---|---|---|---|
| MZKE 1820 00A0 45A:- | 8b | 0.442 | -27 | 437 | TGGGAGGCCGGC-------------\|--------------<br>GTAGCGCCTCCGCAGGCCATGGAGGTGCGCGTCAAGATCCTCTTCA<br>CCTCGCTCTGCCACACCGACGTCTACTTCTGGGAGGCCAAGGTATCT<br>AATCAGCCATCCCATTTGTGATCTTTGTCAGTAGATATGATAC |
| MZKE 1820 00A0 45A:- | 9a | 0.468 | -7 | 438 | TGGGAGGCCGGCAAGCCACTGTCG-\|------<br>AGGTGGAGGTAGCGCCTCCGCAGGCCATGGAGGTGCGCGTCAAGA<br>TCCTCTTCACCTCGCTCTGCCACACCGACGTCTACTTCTGGGAGGCCA<br>AGGTATCTAATCAGCCATCCCATTTGTGATCTTTGTCAGTAGATATGA<br>TAC |
| MZKE 1820 00A0 45A:- | 9b | 0.458 | -2 | 439 | TGGGAGGCCGGCAAGCCACTGTCGA\|--<br>GAGGGTGGAGGTAGCGCCTCCGCAGGCCATGGAGGTGCGCGTC<br>AAGATCCTCTTCACCTCGCTCTGCCACACCGACGTCTACTTCTGGGAG<br>GCCAAGGTATCTAATCAGCCATCCCATTTGTGATCTTTGTCAGTAGAT<br>ATGATAC |
| MZKE 1820 00A0 45A:- | 10a | 0.462 | -7 | 440 | TGGGAGGCCGGCAAGCCA-------<br>\|TCGAGGAGGTGGAGGTAGCGCCTCCGCAGGCCATGGAGGTGCGC<br>GTCAAGATCCTCTTCACCTCGCTCTGCCACACCGACGTCTACTTCTGG<br>GAGGCCAAGGTATCTAATCAGCCATCCCATTTGTGATCTTTGTCAGT<br>AGATATGATAC |
| MZKE 1820 00A0 45A:- | 10b | 0.455 | -6 | 441 | TGGGAGGCCGGCAAGCCACTGTCG-\|-----<br>GAGGTGGAGGTAGCGCCTCCGCAGGCCATGGAGGTGCGCGTCAAG<br>ATCCTCTTCACCTCGCTCTGCCACACCGACGTCTACTTCTGGGAGGCC<br>AAGGTATCTAATCAGCCATCCCATTTGTGATCTTTGTCAGTAGATATG<br>ATAC |
| MZKE 1820 00A0 45A:- | 11a | 0.486 | -2 | 442 | TGGGAGGCCGGCAAGCCACTGTC--<br>\|TCGAGGAGGTGGAGGTAGCGCCTCCGCAGGCCATGGAGGTGCGC<br>GTCAAGATCCTCTTCACCTCGCTCTGCCACACCGACGTCTACTTCTGG<br>GAGGCCAAGGTATCTAATCAGCCATCCCATTTGTGATCTTTGTCAGT<br>AGATATGATAC |
| MZKE 1820 00A0 45A:- | 11b | 0.479 | -1 | 443 | TGGGAGGCCGGCAAGCCACTGTCG-<br>\|TCGAGGAGGTGGAGGTAGCGCCTCCGCAGGCCATGGAGGTGCGC<br>GTCAAGATCCTCTTCACCTCGCTCTGCCACACCGACGTCTACTTCTGG<br>GAGGCCAAGGTATCTAATCAGCCATCCCATTTGTGATCTTTGTCAGT<br>AGATATGATAC |
| MZKE 1820 00A0 45A:- | 12a | 0.440 | -1 | 444 | TGGGAGGCCGGCAAGCCACTGTCG-<br>\|TCGAGGAGGTGGAGGTAGCGCCTCCGCAGGCCATGGAGGTGCGC<br>GTCAAGATCCTCTTCACCTCGCTCTGCCACACCGACGTCTACTTCTGG<br>GAGGCCAAGGTATCTAATCAGCCATCCCATTTGTGATCTTTGTCAGT<br>AGATATGATAC |
| MZKE 1820 00A0 45A:- | 12b | 0.100 | 13 | 445 | TGGGAGGCCGGCAAGCCACTGTCGA\|nnnnnnnnnnnnnTCGAGGA<br>GGTGGAGGTAGCGCCTCCGCAGGCCATGGAGGTGCGCGTCAAGAT<br>CCTCTTCACCTCGCTCTGCCACACCGACGTCTACTTCTGGGAGGCCAA<br>GGTATCTAATCAGCCATCCCATTTGTGATCTTTGTCA |
| MZKE 1820 00A0 45A:- | 13a | 0.474 | -4 | 446 | TGGGAGGCCGGCAAGCCACTGTCGA\|----<br>GGAGGTGGAGGTAGCGCCTCCGCAGGCCATGGAGGTGCGCGTCAA<br>GATCCTCTTCACCTCGCTCTGCCACACCGACGTCTACTTCTGGGAGGC<br>CAAGGTATCTAATCAGCCATCCCATTTGTGATCTTTGTCAGTAGATAT<br>GATAC |
| MZKE 1820 00A0 45A:- | 13b | 0.470 | -3 | 447 | TGGGAGGCCGGCAAGCCACTGTC--\|-<br>CGAGGAGGTGGAGGTAGCGCCTCCGCAGGCCATGGAGGTGCGCGT<br>CAAGATCCTCTTCACCTCGCTCTGCCACACCGACGTCTACTTCTGGGA<br>GGCCAAGGTATCTAATCAGCCATCCCATTTGTGATCTTTGTCAGTAG<br>ATATGATAC |
| MZKE 1820 00A0 45A:- | 14a | 0.459 | -4 | 448 | TGGGAGGCCGGCAAGCCACTGTCG-\|---<br>AGGAGGTGGAGGTAGCGCCTCCGCAGGCCATGGAGGTGCGCGTCA<br>AGATCCTCTTCACCTCGCTCTGCCACACCGACGTCTACTTCTGGGAG<br>GCCAAGGTATCTAATCAGCCATCCCATTTGTGATCTTTGTCAGTAGAT<br>ATGATAC |
| MZKE 1820 00A0 45A:- | 14b | 0.488 | -1 | 449 | TGGGAGGCCGGCAAGCCACTGTCG-<br>\|TCGAGGAGGTGGAGGTAGCGCCTCCGCAGGCCATGGAGGTGCGC<br>GTCAAGATCCTCTTCACCTCGCTCTGCCACACCGACGTCTACTTCTGG<br>GAGGCCAAGGTATCTAATCAGCCATCCCATTTGTGATCTTTGTCAGT<br>AGATATGATAC |

TABLE 15-continued

| Ped. | Sample | Read % | Edit | SEQ ID NO: | Sequence |
|---|---|---|---|---|---|
| MZKE 1820 00A0 45A:- | 15 | 0.950 | -1 | 450 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 45A:- | 16a | 0.470 | 1 | 451 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 45A:- | 16b | 0.474 | -4 | 452 | TGGGAGGCCGGCAAGCCACTGTCG-\|---AGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 45A:- | 17 | 0.108 | +1 | 453 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 45A:- | 18a | 0.462 | +1 | 454 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 45A:- | 18b | 0.469 | -4 | 455 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 45A:- | 19 | 0.125 | +1 | 456 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 57A:- | 1a | 0.425 | -4 | 457 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 57A:- | 1b | 0.382 | -3 | 458 | TGGGAGGCCGGCAAGCCACTGTCG-\|--GAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 57A:- | 2a | 0.477 | +1 | 459 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 57A:- | 2b | 0.467 | -3 | 460 | TGGGAGGCCGGCAAGCCACTGTCG-\|--GAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 57A:- | 3a | 0.482 | +1 | 461 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 57A:- | 3b | 0.452 | -4 | 462 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 57A:- | 4 | 0.996 | -4 | 463 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

TABLE 15-continued

| Ped. | Sample | Read % | Edit | SEQ ID NO: | Sequence |
|---|---|---|---|---|---|
| MZKE1820 00A0 57A:- | 4a | 0.478 | +1 | 464 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 57A:- | 4b | 0.454 | -4 | 465 | TGGGAGGCCGGCAAGCCACTG----\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE1820 00A0 57A:- | 5 | 0.054 | +9 | 466 | TGGGAGGCCGGCAAGCCACTGTCGA\|nnnnnnnnnTCGAGGAGGTG GAGGTAGCGCCTCCGCAGGCCATGGAGGTGCGCGTCAAGATCCTCT TCACCTCGCTCTGCCACACCGACGTCTACTTCTGGGAGGCCAAGGTA TCTAATCAGCCATCCCATTTGTGATCTTTGTCAGTAG |
| MZKE1820 00A0 57A:- | 6a | 0.490 | -2 | 467 | TGGGAGGCCGGCAAGCCACTGTC--\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE1820 00A0 57A:- | 6b | 0.479 | -4 | 468 | TGGGAGGCCGGCAAGCCACTGTCG-\|--- AGGAGGTGGAGGTAGCGCCTCCGCAGGCCATGGAGGTGCGCGTCA AGATCCTCTTCACCTCGCTCTGCCACACCGACGTCTACTTCTGGGAG GCCAAGGTATCTAATCAGCCATCCCATTTGTGATCTTTGTCAGTAGAT ATGATAC |
| MZKE1820 00A0 57A:- | 7 | 0.161 | -7 | 469 | TGGGAGGCCGGCAAGCCACTGT---\|---- GGAGGTGGAGGTAGCGCCTCCGCAGGCCATGGAGGTGCGCGTCAA GATCCTCTTCACCTCGCTCTGCCACACCGACGTCTACTTCTGGGAGGC CAAGGTATCTAATCAGCCATCCCATTTGTGATCTTTGTCAGTAGATAT GATAC |
| MZKE1820 00A0 57A:- | 8 | 0.079 | +1 | 470 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 57A:- | 9a | 0.481 | +1 | 471 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 57A:- | 9b | 0.468 | -4 | 472 | TGGGAGGCCGGCAAGCCACTG----\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE1820 00A0 57A:- | 10a | 0.404 | -1 | 473 | TGGGAGGCCGGCAAGCCACTGTCGA\|- CGAGGAGGTGGAGGTAGCGCCTCCGCAGGCCATGGAGGTGCGCGT CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE1820 00A0 57A:- | 10b | 0.482 | -22 | 474 | TGGGAGGCCGG--------------\|-------- GTGGAGGTAGCGCCTCCGCAGGCCATGGAGGTGCGCGTCAAGATCC TCTTCACCTCGCTCTGCCACACCGACGTCTACTTCTGGGAGGCCAAG GTATCTAATCAGCCATCCCATTTGTGATCTTTGTCAGTAGATATGATA C |
| MZKE1820 00A0 57A:- | 11a | 0.488 | +1 | 475 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 57A:- | 11b | 0.435 | -5 | 476 | TGGGAGGCCGGCAAGCCACTGTCGA\|----- GAGGTGGAGGTAGCGCCTCCGCAGGCCATGGAGGTGCGCGTCAAG ATCCTCTTCACCTCGCTCTGCCACACCGACGTCTACTTCTGGGAGGCC AAGGTATCTAATCAGCCATCCCATTTGTGATCTTTGTCAGTAGATATG ATAC |
| MZKE1820 00A0 57A:- | 12a | 0.446 | +1 | 477 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |

TABLE 15-continued

| Ped. | Sample | Read % | Edit | SEQ ID NO: | Sequence |
|---|---|---|---|---|---|
| MZKE 1820 00A0 57A:- | 12b | 0.496 | -4 | 478 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 1a | 0.457 | -2 | 479 | TGGGAGGCCGGCAAGCCACTGTC--\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 1b | 0.442 | -14 | 480 | TGGGAGGCCGG--------------\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 2a | 0.448 | -4 | 481 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 2b | 0.473 | -15 | 482 | TGGGAGGCCGGCAAGCCAC------\|---------TGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 3a | 0.442 | -7 | 483 | TGGGAGGCCGGCAAGCCAC------\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 3b | 0.440 | -13 | 484 | TGGGAGGCCGGCAAGCCACTGTCGA\|-------------GGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 4a | 0.370 | +1 | 485 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| MZKE 1820 00A0 64A:- | 4b | 0.466 | -13 | 486 | TGGGAGGCCGGCAAGCCA-------\|------AGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 5a | 0.438 | -4 | 487 | TGGGAGGCCGGCAAGCCACTG----\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 5b | 0.435 | -10 | 488 | TGGGAGGCCGGCAAGCCACTG----\|------AGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 6 | 0.190 | -4 | 489 | TGGGAGGCCGGCAAGCCACTGTC--\|--GAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 00A0 64A:- | 7a | 0.214 | -22 | 490 | TGGGAGGCCGGCAAGCCA-------\|---------------TAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| MZKE 1820 | 7b | 0.082 | -7 | 491 | TGGGAGGCCGGCAAGCCAC------\|-CGAGGAGGTGGAGGTAGCGCCTCCGCAGGCCATGGAGGTGCGCGT |

TABLE 15-continued

| Ped. | Sample | Read % | Edit | SEQ ID NO: | Sequence |
|---|---|---|---|---|---|
| MZKE1820 00A064A:- | | | | | CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE1820 00A064A:- | 8a | 0.486 | -2 | 492 | TGGGAGGCCGGCAAGCCACTGTC--\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE1820 00A064A:- | 8b | 0.443 | -8 | 493 | TGGGAGGCCGGCAAGCCACT-----\|--- AGGAGGTGGAGGTAGCGCCTCCGCAGGCCATGGAGGTGCGCGTCA AGATCCTCTTCACCTCGCTCTGCCACACCGACGTCTACTTCTGGGAG GCCAAGGTATCTAATCAGCCATCCCATTTGTGATCTTTGTCAGTAGAT ATGATAC |
| MZKE1820 00A064A:- | 9a | 0.406 | +1 | 494 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A064A:- | 9b | 0.475 | -10 | 495 | TGGGAGGCCGGCAAGCCA-------\|--- AGGAGGTGGAGGTAGCGCCTCCGCAGGCCATGGAGGTGCGCGTCA AGATCCTCTTCACCTCGCTCTGCCACACCGACGTCTACTTCTGGGAG GCCAAGGTATCTAATCAGCCATCCCATTTGTGATCTTTGTCAGTAGAT ATGATAC |
| MZKE1820 00A064A:- | 10a | 0.257 | -17 | 496 | TGGGAGGCCGGCAAGCCACTGTC--\|--------------- TAGCGCCTCCGCAGGCCATGGAGGTGCGCGTCAAGATCCTCTTCACC TCGCTCTGCCACACCGACGTCTACTTCTGGGAGGCCAAGGTATCTAA TCAGCCATCCCATTTGTGATCTTTGTCAGTAGATATGATAC |
| MZKE1820 00A064A:- | 10b | 0.174 | +1 | 497 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATAC |
| MZKE1820 00A064A:- | 11 | 0.970 | -1 | 498 | TGGGAGGCCGGCAAGCCACTGTCG-\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE1820 00A064A:- | 12a | 0.468 | +1 | 499 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A064A:- | 12b | 0.450 | -9 | 500 | TGGGAGGCCGGCAAGCCACTGTCG-\|-------- GTGGAGGTAGCGCCTCCGCAGGCCATGGAGGTGCGCGTCAAGATCC TCTTCACCTCGCTCTGCCACACCGACGTCTACTTCTGGGAGGCCAAG GTATCTAATCAGCCATCCCATTTGTGATCTTTGTCAGTAGATATGATA C |
| MZKE1820 00A064A:- | 13a | 0.483 | +1 | 501 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A064A:- | 13b | 0.434 | -5 | 502 | TGGGAGGCCGGCAAGCCACTG----\|- CGAGGAGGTGGAGGTAGCGCCTCCGCAGGCCATGGAGGTGCGCGT CAAGATCCTCTTCACCTCGCTCTGCCACACCGACGTCTACTTCTGGGA GGCCAAGGTATCTAATCAGCCATCCCATTTGTGATCTTTGTCAGTAG ATATGATAC |
| MZKE1820 00A064A:- | 14a | 0.489 | -4 | 503 | TGGGAGGCCGGCAAGCCACTG----\|TCGAGGAGGTGGAGGTAGCGCCTCCGCAGGCCATGGAGGTGCGC GTCAAGATCCTCTTCACCTCGCTCTGCCACACCGACGTCTACTTCTGG GAGGCCAAGGTATCTAATCAGCCATCCCATTTGTGATCTTTGTCAGT AGATATGATAC |
| MZKE1820 00A064A:- | 14b | 0.454 | +1 | 504 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |

TABLE 15-continued

| Ped. | Sample | Read % | Edit | SEQ ID NO: | Sequence |
|---|---|---|---|---|---|
| MZKE1820 00A0 64A:- | 15a | 0.477 | +1 | 505 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 64A:- | 15b | 0.425 | -4 | 506 | TGGGAGGCCGGCAAGCCACTGTCG-\|--- AGGAGGTGGAGGTAGCGCCTCCGCAGGCCATGGAGGTGCGCGTCA AGATCCTCTTCACCTCGCTCTGCCACACCGACGTCTACTTCTGGGAG GCCAAGGTATCTAATCAGCCATCCCATTTGTGATCTTTGTCAGTAGAT ATGATAC |
| MZKE1820 00A0 64A:- | 16a | 0.454 | +1 | 507 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 64A:- | 16b | 0.446 | -11 | 508 | TGGGAGGCCGGCAAGCCACTGTC\|--------- TGGAGGTAGCGCCTCCGCAGGCCATGGAGGTGCGCGTCAAGATCCT CTTCACCTCGCTCTGCCACACCGACGTCTACTTCTGGGAGGCCAAGG TATCTAATCAGCCATCCCATTTGTGATCTTTGTCAGTAGATATGATAC |
| MZKE1820 00A0 64A:- | 17a | 0.479 | +1 | 509 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 64A:- | 17b | 0.465 | WT | 510 | TGGGAGGCCGGCAAGCCACTGTCGA\|TCGAGGAGGTGGAGGTAGC GCCTCCGCAGGCCATGGAGGTGCGCGTCAAGATCCTCTTCACCTCGC TCTGCCACACCGACGTCTACTTCTGGGAGGCCAAGGTATCTAATCAG CCATCCCATTTGTGATCTTTGTCAGTAGATATGATAC |
| MZKE1820 00A0 64A:- | 18a | 0.382 | +1 | 511 | TGGGAGGCCGGCAAGCCACTGTCGA\|nTCGAGGAGGTGGAGGTAG CGCCTCCGCAGGCCATGGAGGTGCGCGTCAAGATCCTCTTCACCTCG CTCTGCCACACCGACGTCTACTTCTGGGAGGCCAAGGTATCTAATCA GCCATCCCATTTGTGATCTTTGTCAGTAGATATGATA |
| MZKE1820 00A0 64A:- | 18b | 0.427 | -15 | 512 | TGGGAGGCCGGCAAGCCACT-----\|---------- GGAGGTAGCGCCTCCGCAGGCCATGGAGGTGCGCGTCAAGATCCTC TTCACCTCGCTCTGCCACACCGACGTCTACTTCTGGGAGGCCAAGGT ATCTAATCAGCCATCCCATTTGTGATCTTTGTCAGTAGATATGATAC |

S# = Sample #

Table 16 summarizes the sequencing results of T1 progeny from vector 24460, event numbers MZKE184306A030A, MZKE184306A047A, MZKE184306A060A, MZKE184306A062A, and MZKE184306A104A. Most of the individuals were biallelic, with two different edits inherited from the maternal (egg cell) and paternal (pollen grain/sperm cell) flowers. In some instances, no edit was found or the edits inherited were the same. The information from E1 offspring was used to calculate the maternal editing frequency.

TABLE 16

| Event # | Sample | Percentage | Edit Summary |
|---|---|---|---|
| MZKE184306A030A:- | 1 | 0.43 | -15 |
| MZKE184306A030A:- | 1a | 0.37 | 1 |
| MZKE184306A030A:- | 2 | 0.48 | -2 |
| MZKE184306A030A:- | 2a | 0.47 | WT |
| MZKE184306A030A:- | 3 | 0.48 | -18 |
| MZKE184306A030A:- | 3a | 0.43 | -3 |
| MZKE184306A030A:- | 4 | 0.42 | -15 |
| MZKE184306A030A:- | 4a | 0.40 | 1 |
| MZKE184306A030A:- | 5 | 0.48 | -2 |
| MZKE184306A030A:- | 5a | 0.47 | WT |
| MZKE184306A030A:- | 6 | 0.98 | 1 |
| MZKE184306A030A:- | 7 | 0.51 | -18 |
| MZKE184306A030A:- | 7a | 0.42 | -3 |
| MZKE184306A030A:- | 8 | 0.49 | 1 |

TABLE 16-continued

| Event # | Sample | Percentage | Edit Summary |
|---|---|---|---|
| MZKE184306A030A:- | 8a | 0.45 | WT |
| MZKE184306A047A:- | 1 | 0.41 | 1 |
| MZKE184306A047A:- | 1a | 0.44 | -17 |
| MZKE184306A047A:- | 2 | 0.97 | 1 |
| MZKE184306A047A:- | 3 | 0.28 | -4 |
| MZKE184306A047A:- | 4 | 0.98 | 1 |
| MZKE184306A047A:- | 5 | 0.39 | 1 |
| MZKE184306A047A:- | 5a | 0.42 | -24 |
| MZKE184306A047A:- | 6 | 0.33 | 1 |
| MZKE184306A047A:- | 7 | 0.49 | 1 |
| MZKE184306A047A:- | 7a | 0.44 | -4 |
| MZKE184306A047A:- | 8 | 0.49 | 1 |
| MZKE184306A047A:- | 8a | 0.47 | -1 |
| MZKE184306A047A:- | 9 | 0.98 | 1 |
| MZKE184306A047A:- | 10 | 0.99 | 1 |
| MZKE184306A047A:- | 11 | 0.45 | -1 |
| MZKE184306A047A:- | 11a | 0.44 | -4 |
| MZKE184306A047A:- | 12 | 0.40 | 1 |
| MZKE184306A047A:- | 12a | 0.31 | -10 |
| MZKE184306A047A:- | 13 | 0.97 | 1 |
| MZKE184306A047A:- | 14 | 0.47 | 1 |
| MZKE184306A047A:- | 14a | 0.46 | WT |
| MZKE184306A047A:- | 15 | 0.46 | -4 |
| MZKE184306A047A:- | 15a | 0.52 | -2 |
| MZKE184306A047A:- | 16 | 0.47 | 1 |
| MZKE184306A047A:- | 16a | 0.37 | -4 |
| MZKE184306A047A:- | 17 | 0.43 | 1 |

TABLE 16-continued

| Event # | Sample | Percentage | Edit Summary |
|---|---|---|---|
| MZKE184306A047A:- | 17a | 0.50 | -4 |
| MZKE184306A047A:- | 18 | 0.47 | 1 |
| MZKE184306A047A:- | 18a | 0.45 | -2 |
| MZKE184306A047A:- | 19 | 0.98 | 1 |
| MZKE184306A047A:- | 20 | 0.47 | 1 |
| MZKE184306A047A:- | 20a | 0.36 | 5 |
| MZKE184306A047A:- | 21 | 0.45 | 1 |
| MZKE184306A047A:- | 21a | 0.40 | 4 |
| MZKE184306A047A:- | 22 | 0.49 | 1 |
| MZKE184306A047A:- | 22a | 0.44 | WT |
| MZKE184306A047A:- | 23 | 0.48 | 1 |
| MZKE184306A047A:- | 23a | 0.45 | -4 |
| MZKE184306A047A:- | 24 | 0.50 | 1 |
| MZKE184306A047A:- | 24a | 0.45 | -1 |
| MZKE184306A047A:- | 25 | 0.47 | 1 |
| MZKE184306A047A:- | 25a | 0.46 | -4 |
| MZKE184306A047A:- | 26 | 0.99 | 1 |
| MZKE184306A060A:- | 1 | 0.46 | 1 |
| MZKE184306A060A:- | 1a | 0.45 | -4 |
| MZKE184306A060A:- | 2 | 0.99 | -4 |
| MZKE184306A060A:- | 3 | 0.47 | 1 |
| MZKE184306A060A:- | 3a | 0.45 | WT |
| MZKE184306A060A:- | 4 | 0.49 | 1 |
| MZKE184306A060A:- | 4a | 0.35 | -5 |
| MZKE184306A060A:- | 5 | 0.99 | 1 |
| MZKE184306A060A:- | 6 | 0.97 | 1 |
| MZKE184306A060A:- | 7 | 0.46 | 1 |
| MZKE184306A060A:- | 7a | 0.55 | -3 |
| MZKE184306A060A:- | 8 | 0.99 | -4 |
| MZKE184306A060A:- | 9 | 0.44 | 1 |
| MZKE184306A060A:- | 9a | 0.44 | -7 |
| MZKE184306A060A:- | 10 | 0.99 | 1 |
| MZKE184306A060A:- | 11 | 0.99 | 1 |
| MZKE184306A060A:- | 12 | 0.96 | -1 |
| MZKE184306A060A:- | 13 | 0.97 | 1 |
| MZKE184306A060A:- | 14 | 0.48 | WT |
| MZKE184306A060A:- | 14a | 0.46 | -2 |
| MZKE184306A060A:- | 15 | 0.90 | -4 |
| MZKE184306A060A:- | 16 | 0.48 | 1 |
| MZKE184306A060A:- | 16a | 0.32 | -1 |
| MZKE184306A060A:- | 17 | 0.47 | -15 |
| MZKE184306A060A:- | 17a | 0.40 | -4 |
| MZKE184306A060A:- | 18 | 0.47 | -26 |
| MZKE184306A060A:- | 18a | 0.44 | -21 |
| MZKE184306A060A:- | 19 | 0.46 | WT |
| MZKE184306A060A:- | 19a | 0.46 | -1 |
| MZKE184306A062A:- | 1 | 0.46 | 1 |
| MZKE184306A062A:- | 1a | 0.41 | -13 |
| MZKE184306A062A:- | 2 | 0.47 | 1 |
| MZKE184306A062A:- | 2a | 0.32 | -4 |
| MZKE184306A062A:- | 3 | 0.49 | 1 |
| MZKE184306A062A:- | 3a | 0.44 | -3 |
| MZKE184306A062A:- | 4 | 0.47 | 1 |
| MZKE184306A062A:- | 4a | 0.49 | -1 |
| MZKE184306A062A:- | 5 | 0.48 | 1 |
| MZKE184306A062A:- | 5a | 0.45 | -2 |
| MZKE184306A062A:- | 6 | 0.95 | -4 |
| MZKE184306A062A:- | 7 | 0.51 | -1 |
| MZKE184306A062A:- | 7a | 0.32 | -4 |
| MZKE184306A062A:- | 8 | 0.48 | -3 |
| MZKE184306A062A:- | 8a | 0.47 | -4 |
| MZKE184306A062A:- | 9 | 0.43 | -23 |
| MZKE184306A062A:- | 9a | 0.37 | -7 |
| MZKE184306A062A:- | 10 | 0.36 | 1 |
| MZKE184306A062A:- | 11 | 0.48 | 1 |
| MZKE184306A062A:- | 11a | 0.49 | -1 |
| MZKE184306A062A:- | 12 | 0.99 | 1 |
| MZKE184306A062A:- | 13 | 0.97 | -1 |
| MZKE184306A062A:- | 14 | 0.98 | 1 |
| MZKE184306A062A:- | 15 | 0.43 | 1 |
| MZKE184306A062A:- | 15a | 0.34 | -8 |
| MZKE184306A062A:- | 16 | 0.98 | 1 |
| MZKE184306A062A:- | 17 | 0.49 | 1 |
| MZKE184306A062A:- | 17a | 0.35 | -8 |
| MZKE184306A062A:- | 18 | 0.96 | 1 |
| MZKE184306A062A:- | 19 | 0.60 | -2 |
| MZKE184306A062A:- | 19a | 0.39 | -2 |
| MZKE184306A062A:- | 20 | 0.98 | 1 |
| MZKE184306A062A:- | 21 | 0.48 | 1 |
| MZKE184306A062A:- | 21a | 0.47 | 2 |
| MZKE184306A062A:- | 22 | 0.98 | 1 |
| MZKE184306A062A:- | 23 | 0.96 | -1 |
| MZKE184306A062A:- | 24 | 1.00 | -4 |
| MZKE184306A062A:- | 25 | 0.98 | 1 |
| MZKE184306A062A:- | 26 | 0.99 | 1 |
| MZKE184306A062A:- | 27 | 0.23 | -2 |
| MZKE184306A062A:- | 27a | 0.34 | -2 |
| MZKE184306A062A:- | 28 | 0.48 | 1 |
| MZKE184306A062A:- | 28a | 0.47 | -1 |
| MZKE184306A062A:- | 29 | 0.98 | 1 |
| MZKE184306A062A:- | 30 | 0.99 | 1 |
| MZKE184306A062A:- | 31 | 0.50 | 1 |
| MZKE184306A062A:- | 31a | 0.41 | -4 |
| MZKE184306A062A:- | 32 | 0.48 | 1 |
| MZKE184306A062A:- | 32a | 0.48 | -1 |
| MZKE184306A062A:- | 33 | 0.47 | 3 |
| MZKE184306A062A:- | 33a | 0.44 | 1 |
| MZKE184306A062A:- | 34 | 0.46 | -24 |
| MZKE184306A062A:- | 34a | 0.39 | -2 |
| MZKE184306A062A:- | 35 | 0.49 | 1 |
| MZKE184306A062A:- | 35a | 0.44 | -1 |
| MZKE184306A062A:- | 36 | 0.47 | 4 |
| MZKE184306A062A:- | 36a | 0.42 | 1 |
| MZKE184306A062A:- | 37 | 0.97 | 1 |
| MZKE184306A062A:- | 38 | 0.99 | 1 |
| MZKE184306A062A:- | 39 | 0.48 | -1 |
| MZKE184306A062A:- | 39a | 0.46 | -4 |
| MZKE184306A104A:- | 1 | 0.47 | -4 |
| MZKE184306A104A:- | 1a | 0.44 | WT |
| MZKE184306A104A:- | 2 | 0.49 | -2 |
| MZKE184306A104A:- | 2a | 0.45 | 1 |
| MZKE184306A104A:- | 3 | 0.99 | 1 |
| MZKE184306A104A:- | 4 | 0.48 | 1 |
| MZKE184306A104A:- | 4a | 0.45 | WT |
| MZKE184306A104A:- | 5 | 0.48 | -2 |
| MZKE184306A104A:- | 5a | 0.45 | 1 |
| MZKE184306A104A:- | 6 | 0.49 | -1 |
| MZKE184306A104A:- | 6a | 0.45 | -4 |
| MZKE184306A104A:- | 7 | 0.52 | 1 |
| MZKE184306A104A:- | 7a | 0.39 | -4 |
| MZKE184306A104A:- | 8 | 0.38 | -30 |
| MZKE184306A104A:- | 8a | 0.33 | -1 |
| MZKE184306A104A:- | 9 | 0.98 | 1 |
| MZKE184306A104A:- | 10 | 0.48 | -1 |
| MZKE184306A104A:- | 10a | 0.46 | -2 |
| MZKE184306A104A:- | 11 | 0.69 | WT |
| MZKE184306A104A:- | 12 | 0.47 | 1 |
| MZKE184306A104A:- | 12a | 0.45 | WT |

The total number of different edits, e.g. at least one nucleotide difference, created in the progeny was found. Combined with the leaf editing rate, ADH1 staining data, and pollen mosaicism score, these four data types were combined and used to evaluate FMOS regulatory systems and to understand the timing and tissue specificity of the FMOS constructs.

Out of the 24 FMOS constructs tested, five appeared to be FMOS constructs of high efficacy based on the pollen NGS data, and so we examined some events from those five via NGS and evaluated T1 offspring. Based on the pollen NGS and mosaicism score analysis, we found that three of those five were confirmed as very high quality FMOS constructs: 24320 (prZmBde1-02), 24301 (prZmAP1-01), and 24460 (prOsAP1-01). These constructs gave low or zero editing in most events in the T0 leaf samples and a high diversity of edits in the tassel and progeny—leading to floral mosaicism scores averaging above 3 for most events (predicted over 300 different editing events in the entire tassel, due to the calculation that each tassel has at least 100 spikelets and each spikelet will carry at least 3 edits based on the mosaicism score). The CMP constitutive promoter (construct 24224) showed 100% editing in the leaves. The events also showed close to 100% editing in the tassel by ADH1 stains. The sequences of the edits in different tassel samples of were not analyzed. For several other constructs, while there was little or no evidence of editing in the leaves, the efficiency of editing in the tassel by ADH1 stain was also rather low. This might be due to the fact that the promoter is not very strong in the native state, or perhaps it is strong in the native state but not very specific for the germinal tissues that give rise to pollen. Perhaps the requisite cis- or trans-enhancer sequences were not captured in the region selected for the promoter and/or terminator.

One cassette in vector 24320 utilized prZmBde1-v2, a highly expressed floral-specific promoter taken from the native maize BEARDED EAR1 gene, ID Zm00001d017614 as FMOS promoter. The Cas9 was driven in the construct by the native ZmBde1 promoter sequence from 673v5 for specific expression in early inflorescence meristems (in situ hybridization data from Thompson et al. 2009). The sequence used included the promoter, first exon, first intron, and second exon (partial). This in total is a 5741 bp regulatory sequence, including a 2000 bp upstream promoter sequence+209 bp 5' UTR, 182 bp first exon, large first intron (3332 bp), and partial 15 bp second exon ending with a 3 bp start codon. Two bp changes were used to remove ATG start codons in the exons and to remove one BbsI site for cloning, which does not disrupt any motif of any transcription factor binding sites as determined by Nsite. The terminator sequence after the Cas9 was also from the ZmBde1 native terminator, which consisted of 828 bp downstream of the stop codon, including a 3' untranslated region of 324 bp. Zero out of fourteen events containing this construct exhibited any editing in the leaf. While 3 events had minimal editing in the tassel, 10 events exhibited highly efficient editing of the ADH1 gene in pollen, and there was a large diversity of edits seen in the NGS data from those events (mosaicism score=11.79). There was also a wide diversity of edits inherited in the T1 seed (maternal editing score=73%). A version of this promoter lacking the first intron was used to express Cas9 with the tNOS (construct 24265) or the native ZmBde1 terminator (construct 24266), but neither of these combinations gave highly efficient editing by ADH1 staining. Thus, for this construct, floral expression was improved when the first intron be included as part of the promoter.

Another FMOS cassette in vector 24301, contained prZmAP1-v1, a highly expressed floral-specific promoter taken from the native maize APETALA1 gene, ID Zm00001d007949. The promoter sequence was 2846 bp, and included 520 bp upstream sequence+220 bp 5' UTR, 185 bp first exon, a large intron (2846 bp), and 15 bp of the second exon ending with a 3 bp start codon. The terminator, tZmAP1-v1, was a 953 bp regulatory sequence, including a 324 bp 3' UTR and 629 bp of downstream sequence. Eleven out of fourteen events showed no editing in the leaves (two seedling leaf samples tested) and the other three showed just a very low percentage of editing. Eleven plants showed a very high level of editing in the ADH1 staining. The tassel mosaicism score based on sequencing of the ADH1 target site PCR products from 48 anther samples was 4.16 which indicates high diversity of edits in the T0 tassels. The maternal editing score was 61%. The T1 progeny exhibited diverse editing. Another embodiment could include the rice version of this promoter was tested, taken from the OsAPETALA1 gene (Os07t01089000-02), construct 24660. This promoter also performed well in the leaf sampling and ADH1 pollen staining assay. We examined four events by NGS, and the diverse edits found in the data led to a mosaicism score of 5.86. T1 offspring also showed a wide diversity of editing outcomes.

Another FMOS cassette in vector 24460, contained prOsAP1-v1, a highly expressed floral-specific promoter taken from the native rice APETALA1 gene, ID 0507g01820 or Os07t01089000-02. The promoter sequence contained 2000 bp of upstream sequence+124 bp 5' UTR, a 185 bp first exon with an ATG changed to an AAG at the 5' end to ensure translation doesn't start too early, followed by the first intron (2416 bp), and 15 bp of the second exon ending with a 3 bp start codon. The terminator, tZmAP1-v1, was a 1000 bp regulatory sequence, including a 361 bp 3' UTR and 629 bp of downstream sequence. Fifteen out of fifteen events showed no editing in the leaves (two seedling leaf samples tested) and 13 showed a very high level of editing in the ADH1 staining. The tassel mosaicism score based on sequencing of the ADH1 target site PCR products from up to 48 anther samples per event was 6.01 which indicates high diversity of edits in the T0 tassels. The maternal editing score was 61%. The T1 progeny exhibited diverse editing—we found that the diversity of the T1 matched that seen with the other high functioning FMOS constructs 24320 and 24301—both of those had events that produced over 20 different mutant alleles in their T1 progeny; similarly, 24460 had events that produced over 20 different mutant alleles in their T1 progeny.

Another FMOS construct, 24269, contained prZmAGO18A-v1, a highly expressed germinal cell specific promoter taken from the maize ARGONAUTE18A gene, ID Zm00001d006351. The Cas9 was driven in the construct by the native ZmAGO18A promoter sequence including a 1,225 bp upstream sequence, the first exon including the entire 5' UTR and a 755 bp intron up to the first 15 bp of exon 2. The terminator consisted of 1116 bp of sequence downstream of the stop codon including the 3' UTR the stop codon (including the 3' UTR). Thirteen out of fifteen events did not exhibit editing in the leaves, and those thirteen also exhibited efficient editing and a medium degree of mosaicism in the pollen ADH1 stain. The T1 seed data indicated a high diversity of edits inherited in the progeny (maternally-derived editing percentage was 62%). However, many of the edits in the offspring were. This fact that so many offspring were carrying the same edited sequence led to the hypothesis that the editing occurred in some events quite early in the meristem development—such that a large sector of the T0 events all carried the same edits. Indeed, this hypothesis is supported by the NGS analysis—using our novel mosaicism score method to analyze the NGS data, we found that the mosaicism score was far lower than for the other FMOS promoters—only 1.24. While this is still at least 14-fold higher than a ubiquitous or constitutive promoter, it is 3 to 10 times lower than the other FMOS promoters. These analyses both confirm the robustness of our assay pipeline and confirm the power of the mosaicism score process to clarify exactly how well certain FMOS promoters are performing relative to others.

Finally, to confirm the floral tissue expression enrichment and reveal the stage of flower development that these promoters are driving high editing enzyme expression, we performed qRT-PCR on T1 plants that carried one copy of the FMOS promoter editing construct. We tested 3 events from constructs 24320 (prZmBde1-02: events MZKE182000A057A, MZKE182000A064A, and MZKE182000A028A), 24301 (prZmAP1-01: events MZKE181800A050A, MZKE181800A033A, and MZKE181800A073A), and 24269 (prZmAGO18A-01:

events MZKE181002A088A, MZKE181002A080A, and MZKE181002A121A). We tested the expression of both the PMI selectable marker (Phosphomannose Isomerase) which was under control of a constitutive promoter) (FIG. 41) and Cas9 (FIG. 42), which was under the control of the FMOS promoter. The qRT assays utilized a positive control gene, Elongation Factor 1a, for normalization against all sample types. We collected samples from the young (<3 cm) tassel prior to flower formation, the pre-meiotic anther (<1 mm), the young (<3 cm) ear primordia, and unfertilized, R1-staged kernels.

Figure 41:
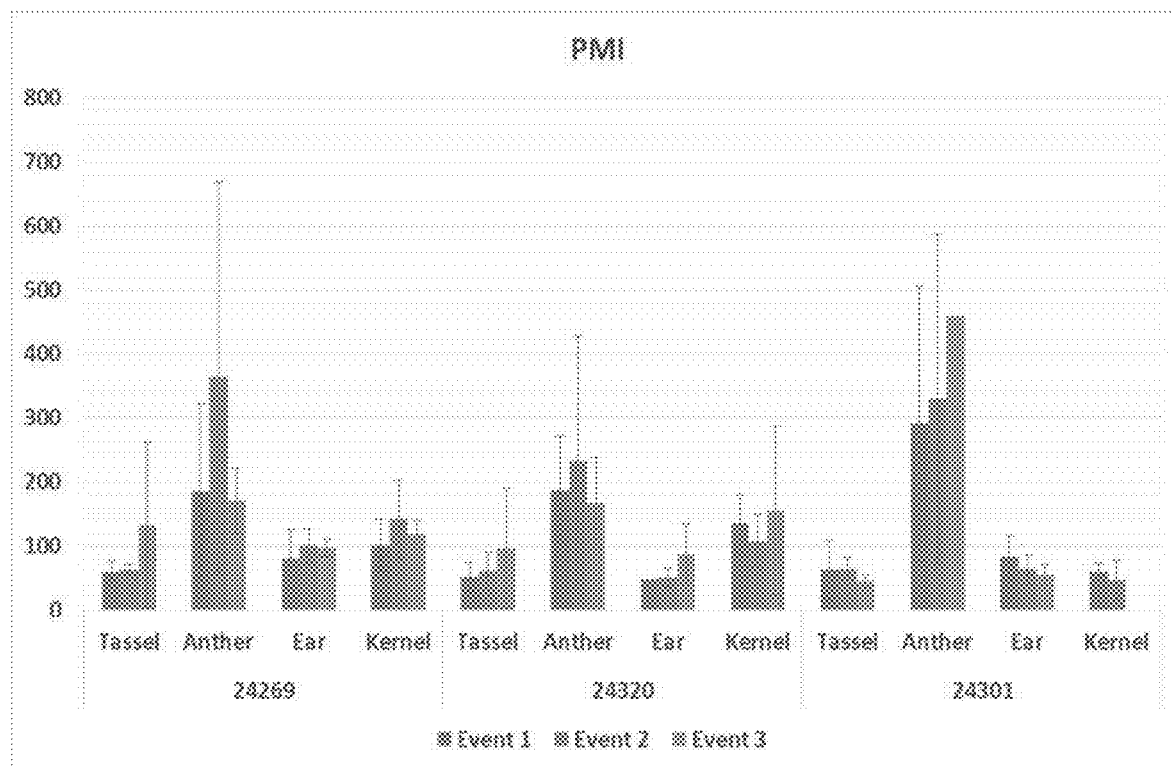
FIG. 41 is a graph showing expression levels of PMI under the control of a constitutive promoter.
Figure 42:
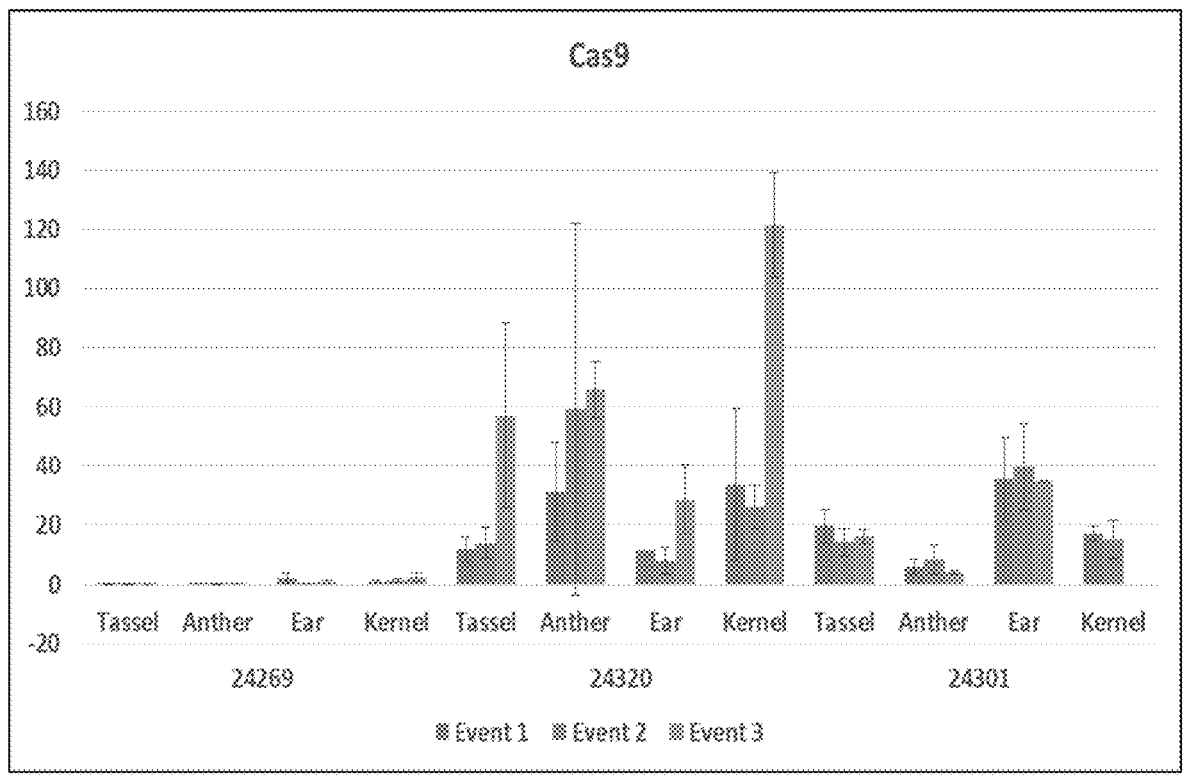
FIG. 42 is a graph showing expression levels of Cas9 under the control of a FMOS promoter.
Figure 43:
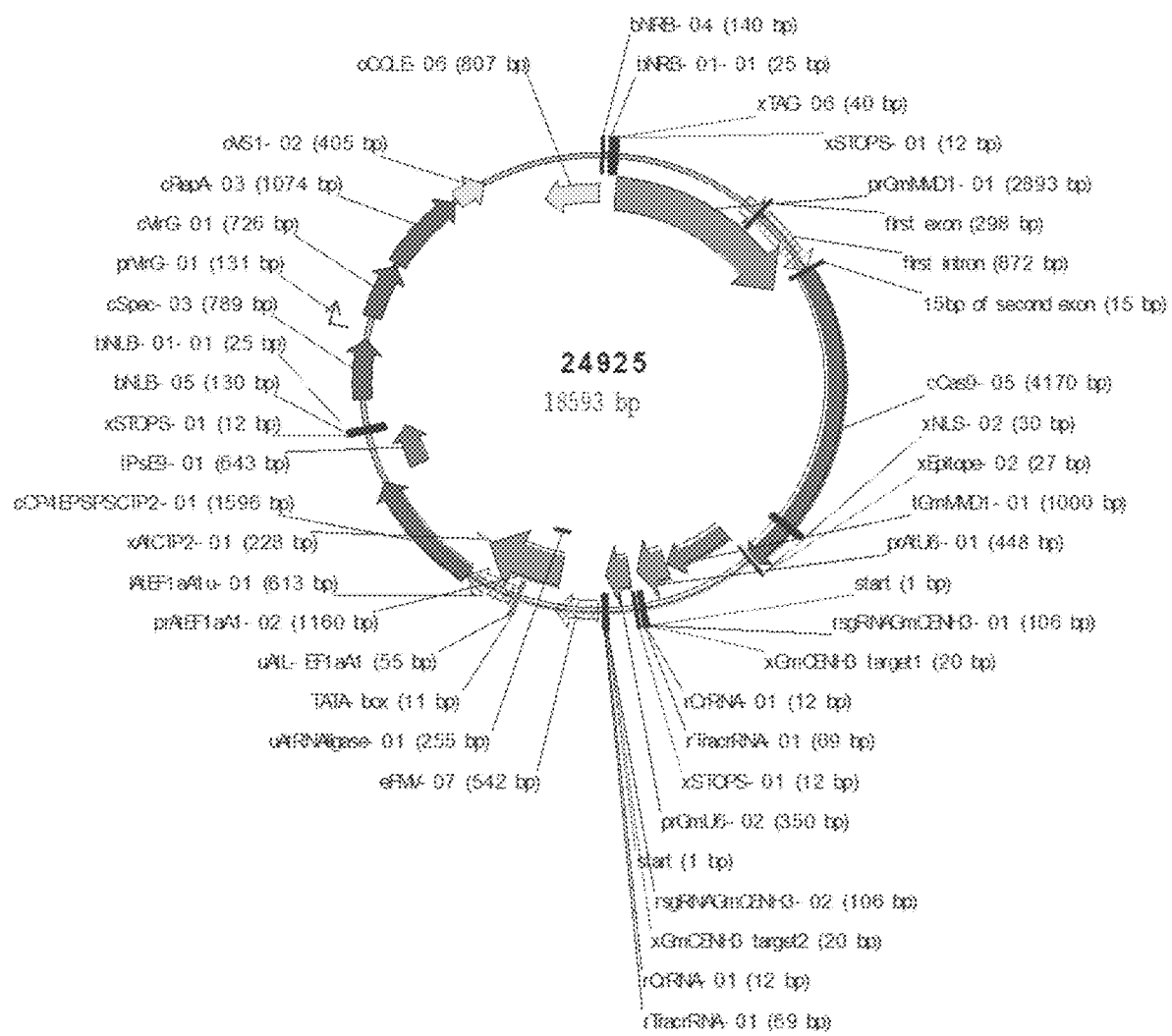
FIG. 43 is a schematic drawing of Vector 24925 used for transformation of maize immature embryos.

As seen in FIG. 41, showing the expression of the selectable marker gene PMI via qRT-PCR, the PMI gene is expressed in all events in all constructs. While the level varied among different floral tissues (anthers were the most enriched), it was fairly equivalent between events and constructs. As seen in FIG. 42, showing the expression of the nuclease Cas9 via qRT-PCR, the Cas9 gene is expressed in all events in all constructs, although for 24269, the expression was quite low in all tissue types. This is likely due to the fact that the construct 24269 uses prZmAGO18a, which is specific to the germinal cells (pre-meiotic cells) of which there are very few when compared to all of the somatic cells of these tissues. Thus, the Cas9 signal may be diluted by extracting total RNA from the entire inflorescence. In contrast, the expression of Cas9 using the prZmBde1-02 (24320) and ZmAP1-01 (24301) was high in floral tissues, including in both male and female (tassel, anther, ear, and kernel). It was fairly equivalent between different events of the constructs.

Example 5: Maintaining FMOS Promoter Efficacy with Promoter Modification

FMOS promoters according to applicant's teachings, e.g. as exemplified in Examples 1~4 above, may be readily modified and still maintain FMOS activity. By way of example, prZmBde1 was modified to remove domains that lacked notable floral transcription factor binding motifs and that were not immediately up or downstream of the transcription or translational start sites. To test whether these domains were dispensable to FMOS activity, we removed them and then rebuilt the constructs and retested them through the same process as described in examples 2 and 3. For example, we built promoter prZmBde1-03 (SEQ ID NO: 615) by removing 1,696 bp from the intron (iZmBde1-01) within prZmBde1-02 in construct 25002 (SEQ ID NO: 538). We produced ten events and had 8/10 events displayed no editing in the leaves (Taqman assay of 2, meaning both copies of ADH1 were unedited). Of those eight, 7 were predominantly negative for the ADH1 pollen assay in most spikelet samples (showing a good degree of editing) (Table 17). Of those seven, we performed NGS on three events (GVG01189795, GVG01189803, and GVG01192964) and found a mosaicism score of 11.72 on average.

TABLE 17

Leaf assay and pollen ADH1 staining scores for ten events from construct 25002, a shortened version of the ZmBde1-02 promoter with a large section of the intron removed.

| Row | 1 | 2 | 3 | 4 | 5 | 6 | 7 | 8 | 9 | 10 | 11 | 12 | Leaf Assay | Event ID |
|---|---|---|---|---|---|---|---|---|---|---|---|---|---|---|
| A | 5 | 15 | 10 | 15 | 25 | 40 | 30 | 40 | 25 | 30 | 35 | 40 | 2 | GVG01189798 |
| B | 5 | 10 | 15 | 25 | 15 | 25 | 25 | 15 | 20 | 15 | 30 | 50 | | |
| C | | | | | | | | | | | | | | |
| D (−control) | 90 | 90 | 90 | 90 | 90 | 85 | 80 | 85 | 75 | 80 | 85 | 95 | | |
| E | 5 | 5 | 10 | 10 | 15 | 10 | 20 | 15 | 15 | 10 | 30 | 25 | 2 | GVG01189803 |
| F | 1 | 5 | 2 | 5 | 15 | 10 | 1 | 1 | 1 | 5 | 2 | 1 | | |
| G | | | | | | | | | | | | | | |
| H | | | | | | | | | | | | | | |
| A | 25 | 30 | 30 | 40 | 40 | 40 | 30 | 30 | 25 | 40 | 25 | 25 | 1 | GVG01189799 |
| B | 10 | 10 | 10 | 10 | 25 | 35 | 25 | 25 | 40 | 40 | 40 | 40 | | |
| C | | | | | | | | | | | | | | |
| D (−control) | | | | | | 75 | 80 | 90 | 95 | 75 | 90 | | | |
| E | 5 | 40 | 20 | 45 | 30 | 40 | 35 | 35 | 20 | 20 | 40 | 30 | 2 | GVG011898005 |
| F | 10 | 15 | 10 | 25 | 20 | 30 | 25 | 30 | 35 | 15 | 15 | 20 | | |
| G | | | | | | | | | | | | | | |
| H (−control) | 95 | 95 | 95 | 90 | 95 | 90 | 90 | 90 | 95 | 95 | 95 | 95 | | |
| A | 1 | 1 | 1 | 10 | 10 | 10 | 10 | 15 | 30 | 1 | 10 | 30 | 2 | GVG0118970595 |
| B | 5 | 7 | 10 | 15 | 10 | 15 | 25 | 10 | 25 | 30 | 35 | 25 | | |
| C | 5 | 5 | 1 | 5 | 15 | 10 | 10 | 10 | 20 | 15 | 15 | 15 | | |
| D | 10 | 15 | 25 | 30 | 35 | 20 | | | | | | | | |
| E | 0 | 1 | 1 | 1 | 1 | 1 | 0 | 1 | 1 | 0 | 1 | 0 | 0 | GVG01189802 |
| F | 1 | 0 | 1 | 0 | 1 | 1 | 0 | 0 | 0 | 0 | 0 | 0 | | |
| G | 2 | 2 | 0 | 1 | 0 | 0 | 0 | 1 | 1 | 0 | 0 | 0 | | |
| H | 2 | 1 | 1 | 1 | 0 | 0 | 1 | 0 | 1 | 5 | 1 | 0 | | |
| A | 25 | 15 | 10 | 15 | 30 | 25 | 20 | 10 | 15 | 15 | 7 | 10 | 2 | GVG01189801 |
| B | 7 | 10 | 10 | 20 | 25 | 30 | 20 | 20 | 15 | 20 | 10 | 15 | | |
| C | | | | | | | | | | | | | | |
| D (−control) | 75 | 80 | 90 | 70 | 80 | 75 | 80 | 75 | 70 | 90 | 80 | 80 | | |
| E | 5 | 25 | 20 | 30 | 25 | 30 | 20 | 15 | 25 | 30 | 25 | 20 | 2 | GVG01189794 |
| F | 10 | 15 | 25 | 10 | 15 | 20 | | | | | | | | |
| G | | | | | | | | | | | | | | |
| H (−control) | 75 | 80 | 80 | 80 | 80 | 80 | 85 | 80 | 85 | 85 | 80 | 85 | | |

TABLE 17-continued

Leaf assay and pollen ADH1 staining scores for ten events from construct 25002, a shortened version of the ZmBde1-02 promoter with a large section of the intron removed.

| Row | 1 | 2 | 3 | 4 | 5 | 6 | 7 | 8 | 9 | 10 | 11 | 12 | Leaf Assay | Event ID |
|---|---|---|---|---|---|---|---|---|---|---|---|---|---|---|
| A | 90 | 90 | 95 | 97 | 93 | 97 | 95 | 95 | 95 | 95 | 90 | 90 | 2 | GVG01192965 |
| B | 95 | 97 | 97 | 97 | 95 | 95 | 97 | 95 | 95 | 97 | 97 | 97 | | |
| C | | | | | | | | | | | | | | |
| D (−control) | | | | | | | 95 | 95 | 90 | 90 | 95 | 95 | | |
| E | 5 | 7 | 10 | 25 | 10 | 25 | 20 | 30 | 25 | 15 | 15 | 10 | 2 | GVG01192964 |
| F | 15 | 5 | 3 | 15 | 20 | 25 | 25 | 35 | 35 | 15 | 20 | 25 | | |
| G | | | | | | | | | | | | | | |
| H (−control) | | | | | | | 95 | 97 | 95 | 95 | 97 | 97 | | |

We germinated 100 self-pollinated T1 offspring from three events (GVG01189795, GVG01189803, and GVG01192964) and did PCR-sequencing on the target site of a subset. We found dozens of different edits and a wide diversity of editing outcomes deriving from both the T1 male and female inflorescences. As exemplified in table 18 below (from event GVG01189803), we find that the different individuals contain a diversity of edits often in 50% proportion of reads: in other words, the T1 plants are very often biallelic, having received two different edits—one from the male gametophyte (pollen-derived, or tassel-derived) and one from the female gametophyte (egg-derived, or ear-derived). In some cases the edits received from the male and female are identical in these T1 offspring.

TABLE 18

T1 editing outcomes in promoter 25002, event GVG1189803.

| Event ID # | Plant No | % | Position | SEQ ID NO | Sequence |
|---|---|---|---|---|---|
| GVG01189803 | 1 | 0.500 | WT | SEQ ID NO: 549 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01189803 | 1 | 0.470 | −1 | SEQ ID NO: 550 | TGGGAGGCCGGCAAGCCACTGTCGA\|- CGAGGAGGTGGAGGTAGCGCCTCCGCAGGCCA TGGAGGTGCGCGTCAAGATCCTCTTCACCTCGCT CTGCCACACCGACGTCTACTTCTGGGAGGCCAA GGTATCTAATCAGCCATCCCATTTGTGATCTTTGT CAGTAGATATGATAC |
| GVG01190801 | 2 | 0.490 | −4 | SEQ ID NO: 551 | TGGGAGGCCGGCAAGCCACTGTCGA\|---- GGAGGTGGAGGTAGCGCCTCCGCAGGCCATGG AGGTGCGCGTCAAGATCCTCTTCACCTCGCTCTG CCACACCGACGTCTACTTCTGGGAGGCCAAGGT ATCTAATCAGCCATCCCATTTGTGATCTTTGTCAG TAGATATGATAC |
| GVG01190801 | 2 | 0.480 | −9 | SEQ ID NO: 552 | TGGGAGGCCGGCAAGCCACTGTCG-\|--------- GTGGAGGTAGCGCCTCCGCAGGCCATGGAGGT GCGCGTCAAGATCCTCTTCACCTCGCTCTGCCAC ACCGACGTCTACTTCTGGGAGGCCAAGGTATCTA ATCAGCCATCCCATTTGTGATCTTTGTCAGTAGAT ATGATAC |
| GVG01190801 | 3 | 0.490 | −1 | SEQ ID NO: 553 | TGGGAGGCCGGCAAGCCACTGTCGA\|- CGAGGAGGTGGAGGTAGCGCCTCCGCAGGCCA TGGAGGTGCGCGTCAAGATCCTCTTCACCTCGCT CTGCCACACCGACGTCTACTTCTGGGAGGCCAA GGTATCTAATCAGCCATCCCATTTGTGATCTTTGT CAGTAGATATGATAC |
| GVG01190801 | 3 | 0.480 | 1 | SEQ ID NO: 554 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |

TABLE 18-continued

T1 editing outcomes in promoter 25002, event GVG1189803.

| Event ID # | Plant No | % | Position | SEQ ID NO | Sequence |
|---|---|---|---|---|---|
| GVG01190801 | 4 | 0.510 | Wt | SEQ ID NO: 555 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 4 | 0.460 | −2 | SEQ ID NO: 556 | TGGGAGGCCGGCAAGCCACTGTCGA\|-- GAGGAGGTGGAGGTAGCGCCTCCGCAGGCCAT GGAGGTGCGCGTCAAGATCCTCTTCACCTCGCTC TGCCACACCGACGTCTACTTCTGGGAGGCCAAG GTATCTAATCAGCCATCCCATTTGTGATCTTTGTC AGTAGATATGATAC |
| GVG01190801 | 5 | 0.890 | −4 | SEQ ID NO: 557 | TGGGAGGCCGGCAAGCCACTGTCGA\|---- GGAGGTGGAGGTAGCGCCTCCGCAGGCCATGG AGGTGCGCGTCAAGATCCTCTTCACCTCGCTCTG CCACACCGACGTCTACTTCTGGGAGGCCAAGGT ATCTAATCAGCCATCCCATTTGTGATCTTTGTCAG TAGATATGATAC |
| GVG01190801 | 6 | 0.490 | 1 | SEQ ID NO: 558 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATGATA |
| GVG01190801 | 6 | 0.480 | −1 | SEQ ID NO: 559 | TGGGAGGCCGGCAAGCCACTGTCG- \|TCGAGGAGGTGGAGGTAGCGCCTCCGCAGGCC ATGGAGGTGCGCGTCAAGATCCTCTTCACCTCGC TCTGCCACACCGACGTCTACTTCTGGGAGGCCAA GGTATCTAATCAGCCATCCCATTTGTGATCTTTGT CAGTAGATATGATAC |
| GVG01190801 | 7 | 0.470 | −3 | SEQ ID N 0: 560 | TGGGAGGCCGGCAAGCCACTGT--- \|TCGAGGAGGTGGAGGTAGCGCCTCCGCAGGCC ATGGAGGTGCGCGTCAAGATCCTCTTCACCTCGC TCTGCCACACCGACGTCTACTTCTGGGAGGCCAA GGTATCTAATCAGCCATCCCATTTGTGATCTTTGT CAGTAGATATGATAC |
| GVG01190801 | 7 | 0.460 | −8 | SEQ ID NO: 561 | TGGGAGGCCGGCAAGCCAC------\|-- GAGGAGGTGGAGGTAGCGCCTCCGCAGGCCAT GGAGGTGCGCGTCAAGATCCTCTTCACCTCGCTC TGCCACACCGACGTCTACTTCTGGGAGGCCAAG GTATCTAATCAGCCATCCCATTTGTGATCTTTGTC AGTAGATATGATAC |
| GVG01190801 | 8 | 0.520 | 1 | SEQ ID NO: 562 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 8 | 0.430 | −6 | SEQ ID NO: 563 | TGGGAGGCCGGCAAGCCACTGTCG-\|----- GAGGTGGAGGTAGCGCCTCCGCAGGCCATGGA GGTGCGCGTCAAGATCCTCTTCACCTCGCTCTGC CACACCGACGTCTACTTCTGGGAGGCCAAGGTA TCTAATCAGCCATCCCATTTGTGATCTTTGTCAGT AGATATGATAC |
| GVG01190801 | 9 | 0.510 | −4 | SEQ ID NO: 564 | TGGGAGGCCGGCAAGCCACTGTCGA\|---- GGAGGTGGAGGTAGCGCCTCCGCAGGCCATGG AGGTGCGCGTCAAGATCCTCTTCACCTCGCTCTG CCACACCGACGTCTACTTCTGGGAGGCCAAGGT ATCTAATCAGCCATCCCATTTGTGATCTTTGTCAG TAGATATGATAC |
| GVG01190801 | 9 | 0.430 | 2 | SEQ ID NO: 565 | TGGGAGGCCGGCAAGCCACTGTCGA\|nnTCGAG GAGGTGGAGGTAGCGCCTCCGCAGGCCATGGA GGTGCGCGTCAAGATCCTCTTCACCTCGCTCTGC CACACCGACGTCTACTTCTGGGAGGCCAAGGTA |

TABLE 18-continued

T1 editing outcomes in promoter 25002, event GVG1189803.

| Event ID # | Plant No | % | Position | SEQ ID NO | Sequence |
|---|---|---|---|---|---|
| | | | | | TCTAATCAGCCATCCCATTTGTGATCTTTGTCAGT AGATATGAT |
| GVG01190801 | 10 | 0.480 | -4 | SEQ ID NO: 566 | TGGGAGGCCGGCAAGCCACTGTCGA\|---- GGAGGTGGAGGTAGCGCCTCCGCAGGCCATGG AGGTGCGCGTCAAGATCCTCTTCACCTCGCTCTG CCACACCGACGTCTACTTCTGGGAGGCCAAGGT ATCTAATCAGCCATCCCATTTGTGATCTTTGTCAG TAGATATGATAC |
| GVG01190801 | 10 | 0.450 | -8 | SEQ ID NO: 567 | TGGGAGGCCGGCAAGCCAC------\|-- GAGGAGGTGGAGGTAGCGCCTCCGCAGGCCAT GGAGGTGCGCGTCAAGATCCTCTTCACCTCGCTC TGCCACACCGACGTCTACTTCTGGGAGGCCAAG GTATCTAATCAGCCATCCCATTTGTGATCTTTGTC AGTAGATATGATAC |
| GVG01190801 | 11 | 0.410 | WT | SEQ ID NO: 568 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 11 | 0.410 | 1 | SEQ ID NO: 569 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 12 | 0.500 | 1 | SEQ ID NO: 570 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 12 | 0.460 | -4 | SEQ ID NO: 571 | TGGGAGGCCGGCAAGCCACTGTCGA\|---- GGAGGTGGAGGTAGCGCCTCCGCAGGCCATGG AGGTGCGCGTCAAGATCCTCTTCACCTCGCTCTG CCACACCGACGTCTACTTCTGGGAGGCCAAGGT ATCTAATCAGCCATCCCATTTGTGATCTTTGTCAG TAGATATGATAC |
| GVG01190801 | 13 | 0.180 | WT | SEQ ID NO: 572 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 13 | 0.050 | -3 | SEQ ID NO: 573 | TGGGAGGCCGGCAAGCCACTGTC--\|- CGAGGAGGTGGAGGTAGCGCCTCCGCAGGCCA TGGAGGTGCGCGTCAAGATCCTCTTCACCTCGCT CTGCCACACCGACGTCTACTTCTGGGAGGCCAA GGTATCTAATCAGCCATCCCATTTGTGATCTTTGT CAGTAGATATGATAC |
| GVG01190801 | 13 | 0.040 | -15 | SEQ ID NO: 574 | TGGGAGGCCGGCAAGCCACTGTCG-\|--------------- GTAGCGCCTCCGCAGGCCATGGAGGTGCGCGTC AAGATCCTCTTCACCTCGCTCTGCCACACCGACG TCTACTTCTGGGAGGCCAAGGTATCTAATCAGCC ATCCCATTTGTGATCTTTGTCAGTAGATATGATAC |
| GVG01190801 | 14 | 0.540 | -28 | SEQ ID NO: 575 | TGGGAGGCCGGCAAGCC--------\|-------------------- CCTCCGCAGGCCATGGAGGTGCGCGTCAAGATC CTCTTCACCTCGCTCTGCCACACCGACGTCTACTT CTGGGAGGCCAAGGTATCTAATCAGCCATCCCAT TTGTGATCTTTGTCAGTAGATATGATAC |
| GVG01190801 | 14 | 0.310 | 1 | SEQ ID NO: 576 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT |

TABLE 18-continued

T1 editing outcomes in promoter 25002, event GVG1189803.

| Event ID # | Plant No | % | Position | SEQ ID NO | Sequence |
|---|---|---|---|---|---|
| | | | | | CTAATCAGCCATCCCATTTGTGATCTTTGTCAGTA GATATGATA |
| GVG01190801 | 15 | 1.000 | WT | SEQ ID NO: 577 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 16 | 0.520 | WT | SEQ ID NO: 578 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 16 | 0.450 | -3 | SEQ ID NO: 579 | TGGGAGGCCGGCAAGCCACTGTC--\|- CGAGGAGGTGGAGGTAGCGCCTCCGCAGGCCA TGGAGGTGCGCGTCAAGATCCTCTTCACCTCGCT CTGCCACACCGACGTCTACTTCTGGGAGGCCAA GGTATCTAATCAGCCATCCCATTTGTGATCTTTGT CAGTAGATATGATAC |
| GVG01190801 | 17 | 0.500 | 1 | SEQ ID NO: 580 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 17 | 0.470 | WT | SEQ ID NO: 581 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 18 | 0.990 | 1 | SEQ ID NO: 582 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 19 | 0.960 | WT | SEQ ID NO: 583 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 20 | 0.510 | 1 | SEQ ID NO: 584 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 20 | 0.460 | WT | SEQ ID NO: 585 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 21 | 0.990 | 1 | SEQ ID NO: 586 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 22 | 0.490 | 1 | SEQ ID NO: | TGGGAGGCCGGCAAGCCACTGTCGA\|nTCGAGG AGGTGGAGGTAGCGCCTCCGCAGGCCATGGAG |

TABLE 18-continued

T1 editing outcomes in promoter 25002, event GVG1189803.

| Event ID # | Plant No | % | Position | SEQ ID NO | Sequence |
|---|---|---|---|---|---|
| | | | | 587 | GTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| GVG01190801 | 22 | 0.470 | -4 | SEQ ID NO: 588 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 23 | 0.510 | -4 | SEQ ID NO: 589 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 23 | 0.450 | -8 | SEQ ID NO: 590 | TGGGAGGCCGGCAAGCCAC------\|--GAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 24 | 0.480 | 1 | SEQ ID NO: 591 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| GVG01190801 | 24 | 0.490 | -1 | SEQ ID NO: 592 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 25 | 0.990 | 1 | SEQ ID NO: 593 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| GVG01190801 | 26 | 0.990 | 1 | SEQ ID NO: 594 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| GVG01190801 | 27 | 0.480 | WT | SEQ ID NO: 595 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 27 | 0.470 | -4 | SEQ ID NO: 596 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 28 | 0.500 | 1 | SEQ ID NO: 597 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |

TABLE 18-continued

T1 editing outcomes in promoter 25002, event GVG1189803.

| Event ID # | Plant No | % | Position | SEQ ID NO | Sequence |
|---|---|---|---|---|---|
| GVG01190801 | 28 | 0.480 | −1 | SEQ ID NO: 598 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 29 | 1.000 | WT | SEQ ID NO: 599 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 30 | 0.590 | 1 | SEQ ID NO: 600 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| GVG01190801 | 30 | 0.320 | WT | SEQ ID NO: 601 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 31 | 0.570 | 1 | SEQ ID NO: 602 | TGGGAGGCCGGCAAGCCACTGTCGA\|nTCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATA |
| GVG01190801 | 31 | 0.370 | WT | SEQ ID NO: 603 | TGGGAGGCCGGCAAGCCACTGTCGA\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 32 | 0.500 | −1 | SEQ ID NO: 604 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 32 | 0.480 | −4 | SEQ ID NO: 605 | TGGGAGGCCGGCAAGCCACTGTCGA\|----GGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 33 | 0.650 | −1 | SEQ ID NO: 606 | TGGGAGGCCGGCAAGCCACTGTCGA\|-CGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |
| GVG01190801 | 33 | 0.350 | −1 | SEQ ID NO: 607 | TGGGAGGCCGGCAAGCCACTGTCG-\|TCGAGGAGGTGGAGGTAGCGCCTCCGCAGGCCATGGAGGTGCGCGTCAAGATCCTCTTCACCTCGCTCTGCCACACCGACGTCTACTTCTGGGAGGCCAAGGTATCTAATCAGCCATCCCATTTGTGATCTTTGTCAGTAGATATGATAC |

TABLE 18-continued

T1 editing outcomes in promoter 25002, event GVG1189803.

| Event ID # | Plant No | % | SEQ PositionID | SEQ ID NO | Sequence |
|---|---|---|---|---|---|
| GVG01190801 | 34 | 0.490 | 1 | SEQ ID NO: 608 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 34 | 0.480 | WT | SEQ ID NO: 609 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |
| GVG01190801 | 35 | 0.990 | 1 | SEQ ID NO: 610 | TGGGAGGCCGGCAAGCCACTGTCGA\|nTCGAGG AGGTGGAGGTAGCGCCTCCGCAGGCCATGGAG GTGCGCGTCAAGATCCTCTTCACCTCGCTCTGCC ACACCGACGTCTACTTCTGGGAGGCCAAGGTAT CTAATCAGCCATCCCATTTGTGATCTTTGTCAGTA GATATGATA |
| GVG01190801 | 36 | 0.990 | WT | SEQ ID NO: 611 | TGGGAGGCCGGCAAGCCACTGTCGA\|TCGAGGA GGTGGAGGTAGCGCCTCCGCAGGCCATGGAGG TGCGCGTCAAGATCCTCTTCACCTCGCTCTGCCA CACCGACGTCTACTTCTGGGAGGCCAAGGTATCT AATCAGCCATCCCATTTGTGATCTTTGTCAGTAG ATATGATAC |

The T0 tassel mosaicism score and T1 diversity for construct 25002 is basically equivalent to the unshortened promoter in example 4. So, prZmBde1-02 and prZmBde1-03 (which is 40% shorter) are roughly equivalent as FMOS promoters.

Interestingly, when we shortened the ZmBde1-02 promoter in a slightly different ways, in construct 25003 (SEQ ID NO: 539), we obtained another effective FMOS promoter. In construct 25003, we included the promoter prZmBde1-04 (SEQ ID NO: 616), which removed 2,337 bp from the intron (iZmBde1-01) within prZmBde1-02. In total length, this promoter is less than 60% of the length of ZmBde1-02 (an alignment will show less than 60% similarity due to the large gap in intron 2 that was removed in the shortened promoter, prZmBde1-04). Despite this large deleted fragment, we found that 12/12 events had no editing in the leaves (specificity was maintained), and again 7 were predominantly negative for the ADH1 pollen assay in most spikelet samples (showing a good degree of editing in the tassel) (Table 14), while 5/12 did not show good editing in the tassel by ADH1 assay.

Table 19 shows leaf assay and pollen ADH1 staining scores for ten events from construct 25003, containing prZmBde1-04, a shortened version of the ZmBde1-02 promoter with a large section of the intron removed constituting over 40% of the total prZmBde1-02 regulatory sequence.

TABLE 19

| | 1 | 2 | 3 | 4 | 5 | 6 | 7 | 8 | 9 | 10 | 11 | 12 | Leaf Assay | Event ID |
|---|---|---|---|---|---|---|---|---|---|---|---|---|---|---|
| A | 15 | 7 | 10 | 20 | 40 | 30 | 30 | 35 | 45 | 40 | 20 | 25 | 2 | GVG01191002 |
| B | 15 | 5 | 10 | 7 | 10 | 20 | 15 | 10 | 7 | 10 | 15 | 20 | | |
| C | | | | | | | | | | | | | | |
| D | | | | | | | | | | | | | | |
| E | 65 | 45 | 40 | 50 | 55 | 65 | 40 | 50 | 80 | 70 | 60 | 85 | 2 | GVG01190993 |
| F | 70 | 75 | 80 | 65 | 40 | 20 | | | | | | | | |
| G | | | | | | | | | | | | | | |
| H control | 70 | 80 | 90 | 90 | 80 | 85 | 90 | 75 | 85 | 90 | 70 | 90 | | |
| A | 90 | 80 | 80 | 85 | 80 | 85 | 80 | 85 | 90 | 90 | 90 | 90 | 2 | GVG01190994 |
| B | 65 | 85 | 80 | 80 | 90 | 80 | 85 | 80 | 75 | 80 | 75 | 80 | | |
| C | 80 | 80 | 80 | 80 | 75 | 85 | | | | | | | | |
| D | | | | | | | | | | | | | | |
| E | 35 | 35 | 50 | 70 | 60 | 60 | 55 | 70 | 70 | 80 | 75 | 70 | 2 | GVG01191005 |
| F | 60 | 65 | 80 | 75 | 70 | 75 | | | | | | | | |
| G | | | | | | | | | | | | | | |
| H control | 85 | 90 | 85 | 90 | 90 | 90 | 95 | 95 | 80 | 75 | 80 | 90 | | |
| A | 30 | 35 | 30 | 20 | 30 | 20 | 15 | 10 | 15 | 20 | 20 | 30 | 2 | GVG01191010 |
| B | 25 | 35 | 10 | 15 | 15 | 25 | 20 | 25 | 15 | 35 | 20 | 25 | | |
| C | | | | | | | | | | | | | | |
| D | | | | | | | 85 | 90 | 80 | 85 | 90 | 95 | | |

TABLE 19-continued

| | 1 | 2 | 3 | 4 | 5 | 6 | 7 | 8 | 9 | 10 | 11 | 12 | Leaf Assay | Event ID |
|---|---|---|---|---|---|---|---|---|---|---|---|---|---|---|
| E | 10 | 15 | 1 | 15 | 10 | 15 | 10 | 10 | 20 | 10 | 10 | 20 | 2 | GVG01191012 |
| F | 7 | 5 | 2 | 10 | 15 | 10 | | | | | | | | |
| G | | | | | | | | | | | | | | |
| H | | | | | | | | | | | | | | |
| A | 30 | 35 | 35 | 45 | 20 | 35 | 30 | 40 | 35 | 30 | 40 | 40 | 2 | GVG01191009 |
| B | 30 | 35 | 30 | 40 | 25 | 30 | | | | | | | | |
| C | | | | | | | | | | | | | | |
| D control | | | | | | | 90 | 90 | 95 | 85 | 85 | 95 | | |
| E | 1 | 2 | 1 | 5 | 25 | 5 | 1 | 10 | 0 | 2 | 0 | 1 | 2 | GVG01191008 |
| F | 0 | 5 | 1 | 2 | 1 | 10 | | | | | | | | |
| G | | | | | | | | | | | | | | |
| H | | | | | | | | | | | | | | |
| A | 80 | 70 | 50 | 75 | 80 | 85 | 70 | 75 | 75 | 50 | 80 | 80 | 2 | GVG01191011 |
| B | 50 | 70 | 40 | 75 | 70 | 70 | 70 | 80 | 80 | 80 | 70 | 75 | | |
| C | | | | | | | | | | | | | | |
| D | | | | | | | | | | | | | | |
| E | 20 | 20 | 25 | 35 | 50 | 45 | 20 | 40 | 50 | 50 | 50 | 30 | 2 | GVG01190999 |
| F | 1 | 45 | 30 | 0 | 15 | 50 | 30 | 35 | 25 | 15 | 10 | 40 | | |
| G | | | | | | | | | | | | | | |
| H | | | | | | | | | | | | | | |
| A | | 1 | 0 | 10 | 10 | 1 | 20 | 7 | 10 | 25 | 30 | 40 | 2 | GVG01192970 |
| B | 2 | 0 | 2 | 0 | 2 | 10 | 20 | 15 | 10 | 35 | 35 | 20 | | |
| C | | | | | | | | | | | | | | |
| D control | | | | | | | 90 | 95 | 90 | 90 | 90 | 85 | | |
| E | 80 | 75 | 80 | 85 | 80 | 85 | 90 | 85 | 90 | 85 | 83 | 90 | 2 | GVG01192971 |
| F | 85 | 80 | 80 | 80 | 85 | 80 | 90 | 87 | 85 | 80 | 87 | 90 | | |
| G | | | | | | | | | | | | | | |
| H | | | | | | | | | | | | | | |

Of those 7 events with strong editing in the tassel by ADH1 stain, we performed NGS on four events (GVG01191002, GVG01191008, GVG01191010, and GVG01191012) and found mosaicism. We germinated 100 self-pollinated T1 offspring from three events (GVG01191002, GVG01191010, and GVG01191012) and did PCR-sequencing on the target site of a subset. We found over 20 of different edits among self-pollinated offspring of these events. As exemplified in Table 20 below for event GVG01191002, in just 15 offspring we found by PCR-seq nine different alleles. In most cases the edits found are different (biallelic T1) though in some cases they are the same (homozygous T1 offspring).

Table 20 summarizes T1 PCR-sequencing data for construct 25003 event GVG01191002 showing the ADH1 target site edits among 15 progeny.

TABLE 20

| Event ID# | Plant ID | Percentage | Edit Position |
|---|---|---|---|
| GVG01191002 | 1 | 0.510 | −1 |
| GVG01191002 | 1a | 0.450 | −2 |
| GVG01191002 | 2 | 0.590 | −7 |
| GVG01191002 | 2a | 0.330 | WT |
| GVG01191002 | 3 | 0.470 | 1 |
| GVG01191002 | 3a | 0.460 | −13 |
| GVG01191002 | 4 | 0.690 | WT |
| GVG01191002 | 4a | 0.170 | −9 |
| GVG01191002 | 5 | 0.990 | 1 |
| GVG01191002 | 6 | 0.530 | −1 |
| GVG01191002 | 6a | 0.180 | −17 |
| GVG01191002 | 7 | 0.490 | −4 |
| GVG01191002 | 7a | 0.470 | 1 |
| GVG01191002 | 8 | 0.670 | −4 |
| GVG01191002 | 8a | 0.230 | WT |
| GVG01191002 | 9 | 0.480 | −13 |
| GVG01191002 | 9a | 0.460 | 1 |

TABLE 20-continued

| Event ID# | Plant ID | Percentage | Edit Position |
|---|---|---|---|
| GVG01191002 | 10 | 0.990 | 1 |
| GVG01191002 | 11 | 0.990 | 1 |
| GVG01191002 | 12 | 0.990 | WT |
| GVG01191002 | 13 | 0.700 | 1 |
| GVG01191002 | 13a | 0.190 | −1 |
| GVG01191002 | 14 | 0.440 | −5 |
| GVG01191002 | 14a | 0.430 | −1 |
| GVG01191002 | 15 | 0.760 | WT |
| GVG01191002 | 15a | 0.230 | −1 |

In yet another example, we removed 300 bp from the very start of promoter prZmBde1-02 as well as 1,696 bp from the first intron, to obtain prZmBde1-07 (SEQ ID NO: 619) in construct 25006 (SEQ ID NO: 542)). Seventeen events were produced, and all had zero evidence of leaf editing, while 15/17 showed at least a medium level of editing in via tassel ADH1 staining (Table 21), and 5/17 showed a high degree of editing based on ADH1 staining. Events GVG01195902, GVG01195903, GVG01195904, GVG01195891, and GVG01195894 averaged 14% staining, which works out to be around 75-85% edited pollen assuming a small percentage of the unstained pollen is dead (one can see from the negative controls [WT pollen] that around 10% of pollen is unstained. NGS was performed on corresponding tassel samples from events GVG01195902, GVG01195904, and GVG01195894 and those produced an average mosaicism score of 11.88.

Table 21 shows leaf assay and pollen ADH1 staining scores for ten events from construct 25006, a shortened version of the ZmBde1-02 promoter with a large section of the intron removed and the first 300 bp from the 5' end of the promoter also removed.

TABLE 21

| Row | 1 | 2 | 3 | 4 | 5 | 6 | 7 | 8 | 9 | 10 | 11 | 12 | Leaf Assay | Event ID |
|---|---|---|---|---|---|---|---|---|---|---|---|---|---|---|
| A | 45 | 60 | 36 | 45 | 50 | 50 | 35 | 65 | 45 | 55 | 70 | 45 | 2 | GVG01195896 |
| B | 35 | 40 | 50 | 55 | 70 | 50 | 50 | 45 | 60 | 40 | 40 | 35 | | |
| C | | | | | | | | | | | | | | |
| D | | | | | | | 80 | 85 | 80 | 90 | 95 | 90 | | |
| E | 45 | 45 | 70 | 75 | 80 | 40 | 35 | 40 | 50 | 45 | 60 | 65 | 2 | GVG01195888 |
| F | 55 | 75 | 65 | 65 | 80 | 75 | 50 | 40 | 55 | 55 | 45 | 50 | | |
| G | | | | | | | | | | | | | | |
| H | | | | | | | | | | | | | | |
| A | 10 | 45 | 25 | 45 | 40 | 30 | 20 | 10 | 40 | 8 | 20 | 15 | 2 | GVG01195903 |
| B | 15 | 10 | 40 | 7 | 15 | 10 | 5 | 3 | 20 | 25 | 10 | 20 | | |
| C | | | | | | | | | | | | | | |
| D | | | | | | | 90 | 87 | 80 | 95 | 80 | 90 | | |
| E | 20 | 35 | 40 | 40 | 25 | 30 | 35 | 40 | 50 | 35 | 25 | 30 | 2 | GVG01195905 |
| F | 25 | 20 | 20 | 35 | 35 | 25 | | | | | | | | |
| G | | | | | | | | | | | | | | |
| H control | | | | | | | 90 | 95 | 95 | 90 | 90 | 90 | | |
| A | 20 | 20 | 25 | 40 | 40 | 60 | 50 | 50 | 35 | 35 | 45 | 50 | 2 | GVG01195897 |
| B | 40 | 45 | 30 | 35 | 35 | 30 | | | | | | | | |
| C | | | | | | | | | | | | | | |
| D | | | | | | | | | | | | | | |
| E | 90 | 25 | 90 | 90 | 95 | 90 | 95 | 95 | 90 | 90 | 90 | 90 | 2 | GVG01195900 |
| F | 95 | 90 | 90 | 90 | 90 | 95 | | | | | | | | |
| G | | | | | | | | | | | | | | |
| H | | | | | | | | | | | | | | |
| A | 25 | 20 | 20 | 20 | 15 | 20 | 20 | 40 | 20 | 25 | 20 | 30 | 2 | GVG01195904 |
| B | 15 | 20 | 25 | 25 | 20 | 10 | 15 | 15 | 25 | 15 | 15 | 20 | | |
| C | 10 | 15 | 30 | 20 | 15 | 15 | | | | | | | | |
| D control | | | | | | | 85 | 90 | 90 | 85 | 90 | 90 | | |
| E | 20 | 7 | 25 | 15 | 15 | 30 | 20 | 30 | 30 | 20 | 20 | 10 | 2 | GVG01195891 |
| F | 15 | 15 | 20 | 10 | 10 | 15 | 10 | 2 | 10 | 10 | 20 | 10 | | |
| G | 7 | 10 | 15 | 5 | 5 | 10 | | | | | | | | |
| H | | | | | | | 95 | 97 | 95 | 95 | 97 | 95 | | |
| A | 50 | 65 | 75 | 75 | 70 | 45 | 75 | 60 | 70 | 70 | 75 | 60 | 2 | GVG01195899 |
| B | 75 | 70 | 75 | 80 | 75 | 75 | 30 | 75 | 45 | 75 | 50 | 65 | | |
| C | | | | | | | | | | | | | | |
| D | | | | | | | | | | | | | | |
| E | 7 | 1 | 10 | 5 | 3 | 1 | 1 | 10 | 3 | 5 | 7 | 3 | 2 | GVG01195902 |
| F | 10 | 2 | 10 | 7 | 5 | 7 | | | | | | | | |
| G | | | | | | | | | | | | | | |
| H control | | | | | | | 95 | 95 | 95 | 90 | 95 | 95 | | |
| A | 1 | 5 | 7 | 7 | 7 | 10 | 10 | 7 | 10 | 15 | 7 | 10 | 2 | GVG01195894 |
| B | 1 | 3 | 3 | 1 | 2 | 0 | | | | | | | | |
| C | | | | | | | | | | | | | | |
| D control | | | | | | | 95 | 90 | 90 | 95 | 90 | 90 | | |
| E | 90 | 90 | 95 | 95 | 95 | 95 | 90 | 90 | 90 | 95 | 90 | 90 | 2 | GVG01195889 |
| F | 85 | 80 | 85 | 80 | 85 | 90 | 90 | 90 | 95 | 90 | 90 | 90 | | |
| G | | | | | | | | | | | | | | |
| H | | | | | | | | | | | | | | |
| A | 45 | 70 | 75 | 80 | 60 | 60 | 50 | 50 | 65 | 35 | 70 | 40 | 2 | GVG01195892 |
| B | 50 | 45 | 20 | 35 | 45 | 50 | | | | | | | | |
| C | | | | | | | | | | | | | | |
| D control | | | | | | | 85 | 95 | 95 | 90 | 95 | 95 | | |
| E | 60 | 45 | 40 | 55 | 35 | 70 | 30 | 45 | 60 | 65 | 55 | 70 | 2 | GVG01195901 |
| F | 55 | 50 | 65 | 60 | 65 | 40 | | | | | | | | |
| G | | | | | | | | | | | | | | |
| H | | | | | | | 97 | 95 | 95 | 90 | 90 | 90 | | |
| A | 45 | 50 | 55 | 55 | 60 | 70 | 65 | 65 | 65 | 50 | 70 | 55 | 2 | GVG01195893 |
| B | 50 | 55 | 65 | 70 | 60 | 50 | | | | | | | | |
| C | | | | | | | | | | | | | | |
| D control | | | | | | | | | | | | | | |
| E | 70 | 45 | 80 | 75 | 45 | 50 | 85 | 70 | 80 | 85 | 85 | 65 | 2 | GVG01195890 |
| F | 40 | 45 | 60 | 50 | 60 | 75 | 75 | 70 | 75 | 80 | 75 | 65 | | |
| G | | | | | | | | | | | | | | |
| H | | | | | | | 90 | 95 | 93 | 93 | 95 | 90 | | |
| A | 60 | 70 | 75 | 60 | 55 | 60 | 55 | 70 | 65 | 50 | 55 | 60 | 2 | GVG01195898 |
| B | 50 | 45 | 45 | 50 | 60 | 45 | | | | | | | | |
| C | | | | | | | | | | | | | | |
| D | | | | | | | | | | | | | | |

100 T1 self-pollinated offspring from the events GVG01195902, GVG01195904, and GVG01195894 were germinated and PCR-sequencing on the gRNA target site of a subset. We found over 20 of different edits among the self-pollinated offspring of these events. In most cases the edits found are different (biallelic T1) though in some cases they are the same (homozygous T1 offspring).

Figure 38:
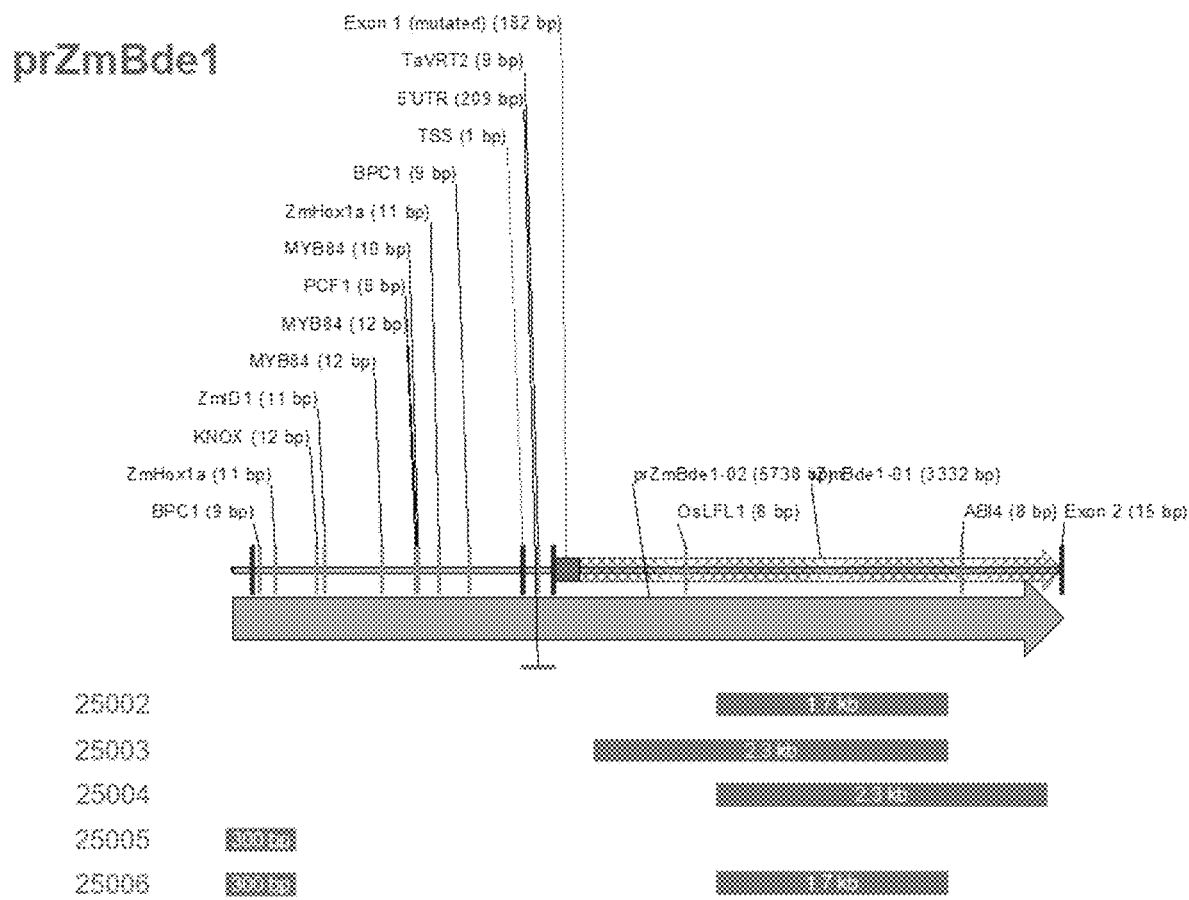
FIGS. 38 and 39 illustrates examples of promoter shortening for various constructs.

Comparing these modified promoter results to construct 24320 (prZmBde1-02), we find that by all measures, the T0 leaf editing, the pollen staining, the NGS diversity, the E1 diversity, and the mosaicism score do not compromise FMOS activity. The one slight exception is we did see a drop in FMOS activity in construct 25003 which removed an 8 bp sequence that corresponds to a putative transcription factor binding motif of the rice transcription factor Leafless1 (LFL1). Interestingly, if you take all of the Bde1 promoter explorations into consideration, it is clear that not even the entire intron is required—in fact you can remove large sections of it, and the promoter still works as an FMOS promoter. Furthermore, you do not need at least the first 300 bp of the promoter that we originally captured in prZmBde1-02. You can take away a larger part of the intron, 2,337 bp (prZmBde1-04) and still get decent FMOS activity, although the mosaicism score does drop by a few points, perhaps due to the absence of the OsLFL1 site. FIG. 38 illustrates a summary of the shortened promoters. In summary, 25002 had an average score of 11.7 (compared to 11.8 from 25320); 25003 had a score of 9.1; 25006 had a score of 11.9. Constructs 25004 and 25005 did not perform well in transformation or editing frequency.

As seen, FMOS promoters developed using Examples 1-5 may be readily modified in a variety of ways and still maintain FMOS promoter efficacy. Further, it is possible using the methods disclosed herein to readily determine if modifications to an FMOS promoter identified using Examples 1-5 have negative effects on FMOS activity. For example, rice AP1 regulatory sequence worked very well as an FMOS promoter in construct 24460, however, in prOsAP1-02 (construct 25007), we removed a large section of the intron; in prOsAP1-03 (construct 25008), we removed a large selection of the promoter; in prOsAP1-04, we remove both sections (from the intron and the promoter). In all three of these constructs, FMOS activity was reduced because some events showed editing in the leaves (ADH1 leaf taqman assay scores of 0 or 1). However, upon further characterization by the ADH1 pollen staining, the tassel spikelet sample NGS and the T1 offspring analysis, FMOS activity was clearly maintained in some cases where the leaf Taqman assay score was 0. For example, in construct 25007, 12 out of 13 events had leaf Taqman assay scores of 0, or just above 0, indicating some editing in the leaf. We assumed that this would mean that the shoot meristem was also already edited, and thus the tassel and ear would not be mosaic. However, if we look at the pollen staining data, we see some samples retained ADH1 activity—exemplifying FMOS activity rather than what we typically see with constitutive promoters (Table 22).

Table 22 shows pollen ADH1 staining assay data. The percentages shown in the wells of these plates are the proportion of pollen sampled that are ADH1+.

TABLE 22

| Table 22 | 1 | 2 | 3 | 4 | 5 | 6 | 7 | 8 | 9 | 10 | 11 | 12 | |
|---|---|---|---|---|---|---|---|---|---|---|---|---|---|
| A | 35 | 1 | 0 | 2 | 1 | 15 | 1 | 0 | 1 | 0 | 5 | 0 | 25007 |
| B | 0 | 0 | 1 | 0 | 1 | 0 | 1 | 5 | 1 | 5 | 10 | 0 | GVG01195931 |
| C | 0 | 0 | 0 | 0 | 1 | 5 | 7 | 2 | 5 | 1 | 2 | 0 | Taqman 0 or 1 |
| D control | | | | | | | 90 | 95 | 90 | 80 | 90 | 95 | |
| E | 5 | 20 | 10 | 7 | 15 | 25 | 10 | 20 | 20 | 15 | 25 | 10 | 25007 |
| F | 5 | 15 | 15 | 20 | 10 | 7 | | | | | | | GVG01195934 |
| | | | | | | | | | | | | | Taqman 0 or 1 |
| A | 0 | 5 | 7 | 15 | 20 | 5 | 15 | 20 | 25 | 10 | 10 | 5 | 25007 |
| B | 5 | 2 | 15 | 10 | 25 | 20 | 5 | 25 | 10 | 10 | 15 | 10 | GVG01195930 |
| | | | | | | | | | | | | | Taqman 0 |
| E | 1 | 2 | 10 | 1 | 1 | 0 | 1 | 7 | 2 | 0 | 25 | 5 | 25007 |
| F | 0 | 2 | 1 | 5 | 10 | 1 | 2 | 5 | 1 | 1 | 0 | 0 | GVG01195937 |
| H control | | | | | | | 90 | 95 | 97 | 95 | 90 | 97 | Taqman 0 |
| A | 1 | 1 | 0 | 0 | 1 | 1 | 1 | 2 | 5 | 0 | 0 | 0 | 25007 |
| B | 1 | 1 | 1 | 0 | 2 | 0 | 0 | 0 | 0 | 1 | 1 | 0 | GVG01195922 |
| C | | | | | | | | | | | | | Taqman 0 |
| D control | | | | | | | 85 | 85 | 95 | 90 | 90 | 90 | |
| E | 0 | 1 | 2 | 1 | 2 | 0 | 0 | 1 | 10 | 5 | 1 | 1 | 25007 |
| F | 0 | 0 | 0 | 7 | 0 | 1 | 1 | 1 | 5 | 5 | 0 | 0 | GVG01195929 |
| | | | | | | | | | | | | | Taqman 0 or 1 |
| A | 0 | 1 | 10 | 1 | 0 | 1 | 1 | 2 | 1 | 1 | 0 | 0 | 25007 |
| B | 0 | 0 | 0 | 0 | 0 | 0 | 0 | 0 | 0 | 0 | 1 | 0 | GVG01195932 |
| C | 0 | 0 | 0 | 0 | 0 | 30 | | | | | | | Taqman 0 |
| E | 0 | 1 | 1 | 1 | 3 | 1 | 0 | 45 | 0 | 2 | 15 | 50 | 25007 |
| F | 1 | 1 | 0 | 0 | 40 | 1 | 2 | 1 | 10 | 7 | 1 | 0 | GVG01195927 |
| G | 1 | 0 | 0 | 1 | 1 | 1 | | | | | | | Taqman 0 |
| H control | | | | | | | 95 | 90 | 95 | 95 | 95 | 97 | |
| A | 0 | 1 | 20 | 3 | 0 | 15 | 0 | 20 | 20 | 0 | 15 | 40 | 25007 |
| B | 30 | 1 | 1 | 20 | 1 | 10 | 0 | 1 | 7 | 5 | 0 | 15 | GVG01195924 |
| | | | | | | | | | | | | | Taqman 2 |
| E | 1 | 1 | 1 | 0 | 1 | 2 | 0 | 0 | 10 | 15 | 0 | 10 | 25007 |
| F | 0 | 1 | 1 | 1 | 1 | 1 | 0 | 0 | 1 | 0 | 0 | 0 | GVG01195933 |
| | | | | | | | | | | | | | Taqman 0 |
| A | 1 | 0 | 1 | 1 | 5 | 3 | 10 | 0 | 1 | 10 | 7 | 5 | 25007 |
| B | 2 | 5 | 5 | 3 | 1 | 15 | 1 | 0 | 0 | 0 | 0 | 1 | GVG01195935 |
| D control | | | | | | | 90 | 90 | 95 | 95 | 93 | 95 | Taqman 0 |
| E | 2 | 3 | 20 | 2 | 7 | 2 | 2 | 5 | 0 | 15 | 2 | 0 | 25007 |
| F | 3 | 1 | 1 | 1 | 1 | 1 | 1 | 1 | 30 | 0 | 2 | 0 | GVG01195925 |
| | | | | | | | | | | | | | Taqman 0 |
| A | 0 | 0 | 1 | 1 | 0 | 3 | 1 | 2 | 3 | 2 | 1 | 1 | 25007 |
| B | 1 | 1 | 1 | 1 | 1 | 1 | | | | | | | GVG01195923 |
| D control | | | | | | | 90 | 95 | 95 | 95 | 90 | 90 | Taqman 0 |

Furthermore, we looked at the T1 data from event GVG01195930, which scored a 0 in the T0 leaf Taqman, we find a wide diversity of edits among predominantly biallelic progeny summarized in Table 23 below.

TABLE 23

| Event ID # | T1 Plant # | Percentage | Edit Position |
|---|---|---|---|
| GVG01195930 | 1 | 1.000 | −1 |
| GVG01195930 | 2 | 0.480 | 7 |
| GVG01195930 | 2a | 0.440 | −1 |
| GVG01195930 | 3 | 0.510 | −4 |
| GVG01195930 | 3a | 0.460 | 1 |
| GVG01195930 | 4 | 1.000 | WT |
| GVG01195930 | 5 | 0.510 | WT |
| GVG01195930 | 5a | 0.460 | −1 |
| GVG01195930 | 6 | 0.510 | 1 |
| GVG01195930 | 6a | 0.270 | −8 |
| GVG01195930 | 7 | 0.450 | −1 |
| GVG01195930 | 7a | 0.310 | −8 |
| GVG01195930 | 8 | 0.500 | −2 |
| GVG01195930 | 8a | 0.470 | 1 |
| GVG01195930 | 9 | 0.490 | WT |
| GVG01195930 | 9a | 0.480 | 1 |
| GVG01195930 | 10 | 0.490 | −4 |
| GVG01195930 | 10a | 0.480 | 1 |
| GVG01195930 | 11 | 1.000 | −1 |
| GVG01195930 | 12 | 0.990 | 1 |
| GVG01195930 | 13 | 0.460 | 1 |
| GVG01195930 | 13a | 0.390 | 6 |
| GVG01195930 | 14 | 1.000 | −1 |
| GVG01195930 | 15 | 0.510 | 1 |
| GVG01195930 | 15a | 0.470 | −1 |
| GVG01195930 | 16 | 0.500 | −1 |
| GVG01195930 | 16a | 0.480 | 1 |
| GVG01195930 | 17 | 0.480 | −3 |
| GVG01195930 | 17a | 0.480 | 1 |
| GVG01195930 | 18 | 0.990 | 1 |
| GVG01195930 | 19 | 0.810 | −40 |
| GVG01195930 | 20 | 0.500 | 1 |
| GVG01195930 | 20a | 0.470 | −4 |
| GVG01195930 | 21 | 0.540 | 1 |
| GVG01195930 | 21a | 0.310 | −1 |
| GVG01195930 | 22 | 1.000 | WT |
| GVG01195930 | 23 | 0.990 | 1 |
| GVG01195930 | 24 | 0.490 | −4 |
| GVG01195930 | 24a | 0.470 | 1 |
| GVG01195930 | 25 | 0.510 | −4 |
| GVG01195930 | 25a | 0.470 | −2 |
| GVG01195930 | 26 | 0.990 | 1 |
| GVG01195930 | 27 | 0.480 | −4 |
| GVG01195930 | 27a | 0.360 | −8 |
| GVG01195930 | 28 | 1.000 | −4 |
| GVG01195930 | 29 | 0.490 | −4 |
| GVG01195930 | 29a | 0.490 | −1 |
| GVG01195930 | 30 | 0.510 | −1 |
| GVG01195930 | 30a | 0.440 | −12 |
| GVG01195930 | 31 | 0.500 | WT |
| GVG01195930 | 31 | 0.460 | −4 |

Similarly, construct 25008, event GVG01195946, produced pollen NGS data with a mosaicism score of 4.97 and T1 data that shows a very broad diversity of edits (Table 24). Table 24 summarizes the diversity of E1 edits from event GVG01195946, which is a shortened version of prOsAP1, namely, prOsAP1-03, which has about 1 kb removed from the promoter.

TABLE 24

| Event ID# | Serial No | Percentage | Edit Position |
|---|---|---|---|
| GVG01195946 | 1 | 1.000 | 4 |
| GVG01195946 | 2 | 0.490 | −4 |
| GVG01195946 | 2 | 0.440 | −10 |
| GVG01195946 | 3 | 0.480 | −2 |
| GVG01195946 | 3 | 0.430 | −1 |
| GVG01195946 | 4 | 0.460 | −1 |

TABLE 24-continued

| Event ID# | Serial No | Percentage | Edit Position |
|---|---|---|---|
| GVG01195946 | 4 | 0.470 | −10 |
| GVG01195946 | 5 | 0.990 | 1 |
| GVG01195946 | 6 | 0.490 | 1 |
| GVG01195946 | 6 | 0.400 | −5 |
| GVG01195946 | 8 | 1.000 | 1 |
| GVG01195946 | 9 | 0.500 | 1 |
| GVG01195946 | 9 | 0.410 | −6 |
| GVG01195946 | 10 | 0.480 | 1 |
| GVG01195946 | 10 | 0.470 | −12 |
| GVG01195946 | 11 | 0.510 | 1 |
| GVG01195946 | 11 | 0.460 | WT |
| GVG01195946 | 12 | 1.000 | 1 |
| GVG01195946 | 13 | 1.000 | −10 |
| GVG01195946 | 14 | 0.460 | −27 |
| GVG01195946 | 14 | 0.470 | −10 |
| GVG01195946 | 15 | 0.450 | −1 |
| GVG01195946 | 15 | 0.450 | −10 |
| GVG01195946 | 16 | 0.450 | 1 |
| GVG01195946 | 16 | 0.510 | −10 |
| GVG01195946 | 17 | 0.480 | WT |
| GVG01195946 | 17 | 0.480 | −4 |
| GVG01195946 | 18 | 0.460 | WT |
| GVG01195946 | 18 | 0.510 | −2 |
| GVG01195946 | 19 | 0.490 | 1 |
| GVG01195946 | 19 | 0.480 | −1 |
| GVG01195946 | 20 | 0.490 | −4 |
| GVG01195946 | 20 | 0.490 | −1 |
| GVG01195946 | 21 | 0.490 | 1 |
| GVG01195946 | 21 | 0.470 | −2 |
| GVG01195946 | 22 | 0.490 | −4 |
| GVG01195946 | 22 | 0.480 | 1 |
| GVG01195946 | 23 | 0.510 | −28 |
| GVG01195946 | 23 | 0.420 | −1 |
| GVG01195946 | 24 | 0.400 | −24 |
| GVG01195946 | 24 | 0.370 | WT |
| GVG01195946 | 25 | 0.540 | −1 |
| GVG01195946 | 25 | 0.430 | −2 |
| GVG01195946 | 26 | 0.490 | 1 |
| GVG01195946 | 26 | 0.470 | WT |
| GVG01195946 | 27 | 0.490 | −4 |
| GVG01195946 | 27 | 0.450 | −10 |
| GVG01195946 | 28 | 0.490 | WT |
| GVG01195946 | 28 | 0.470 | −4 |
| GVG01195946 | 29 | 0.490 | 1 |
| GVG01195946 | 29 | 0.480 | −4 |
| GVG01195946 | 30 | 0.990 | −1 |
| GVG01195946 | 31 | 1.000 | 1 |
| GVG01195946 | 32 | 1.000 | −4 |
| GVG01195946 | 33 | 0.990 | 1 |
| GVG01195946 | 34 | 1.000 | 1 |
| GVG01195946 | 35 | 0.520 | −13 |
| GVG01195946 | 35 | 0.420 | −27 |
| GVG01195946 | 36 | 0.500 | 1 |
| GVG01195946 | 36 | 0.470 | WT |
| GVG01195946 | 37 | 0.460 | −27 |
| GVG01195946 | 37 | 0.420 | 1 |
| GVG01195946 | 38 | 0.580 | 1 |
| GVG01195946 | 38 | 0.300 | 2 |
| GVG01195946 | 39 | 0.340 | 2 |
| GVG01195946 | 39 | 0.080 | −18 |
| GVG01195946 | 40 | 0.490 | −1 |
| GVG01195946 | 40 | 0.480 | 1 |

Similarly, construct 25009 (SEQ ID NO: 545), which used a modified version of prOsAP1 (SEQ ID NO: 622) had more than 52% of the promoter removed (2.4 kB removed total out of a 4.6 kB promoter) and produced good editing diversity for all four of these events, and the NGS data shows numerous edits per sample. See Table 25 for a small example of the NGS data; the mosaicism score for this event GVG01195812 was 5.92. For GVG01195906, it was 6.38, and for GVG01195915, it was 5.63. Table 25 summarizes NGS data for the event GVG01195812, which showed some editing in leaves but still retained FMOS activity, as demonstrated in this table with the wide diversity of edits found in the tassel; at least 5 or 6 edits were found in each pollen sample. The mosaicism score for this event was 5.92.

TABLE 25

| PlantId | Construct | Variant | % | Frameshift | Location | Position |
|---|---|---|---|---|---|---|
| GVG01195912 | 25009 | 123: Insert T | 32 | YES | central spike | 1 |
| GVG01195912 | 25009 | 123: Insert C | 13 | YES | central spike | 1 |
| GVG01195912 | 25009 | 119: Delete TCGA | 4 | YES | central spike | 1 |
| GVG01195912 | 25009 | 121: Delete GAT | 2 | NO | central spike | 1 |
| GVG01195912 | 25009 | 122: Insert A | 39 | YES | central spike | 1 |
| GVG01195912 | 25009 | 122: Delete A | 6 | YES | central spike | 1 |
| GVG01195912 | 25009 | 106: Δ33 | 5 | NO | central spike | 2 |
| GVG01195912 | 25009 | 123: Insert T | 29 | YES | central spike | 2 |
| GVG01195912 | 25009 | 119: Delete TCGA | 4 | YES | central spike | 2 |
| GVG01195912 | 25009 | 123: Delete T | 3 | YES | central spike | 2 |
| GVG01195912 | 25009 | 122: Insert A | 35 | YES | central spike | 2 |
| GVG01195912 | 25009 | 122: Delete A | 5 | YES | central spike | 2 |
| GVG01195912 | 25009 | 120: Insert 11 | 4 | YES | central spike | 2 |
| GVG01195912 | 25009 | 123: Insert C | 2 | YES | central spike | 2 |
| GVG01195912 | 25009 | 121: Delete GA | 1 | YES | central spike | 2 |
| GVG01195912 | 25009 | 123: Insert T | 19 | YES | central spike | 3 |
| GVG01195912 | 25009 | 111: Δ24 | 23 | NO | central spike | 3 |
| GVG01195912 | 25009 | 119: Delete TCGA | 7 | YES | central spike | 3 |
| GVG01195912 | 25009 | 123: Delete T | 2 | YES | central spike | 3 |
| GVG01195912 | 25009 | 122: Insert A | 38 | YES | central spike | 3 |
| GVG01195912 | 25009 | 117: Delete TGTCGA | 4 | NO | central spike | 3 |
| GVG01195912 | 25009 | 122: Delete A | 3 | YES | central spike | 3 |
| GVG01195912 | 25009 | 123: Insert T | 6 | YES | central spike | 4 |
| GVG01195912 | 25009 | 119: Delete TCGA | 34 | YES | central spike | 4 |
| GVG01195912 | 25009 | 122: Insert A | 24 | YES | central spike | 4 |
| GVG01195912 | 25009 | 122: Delete A | 27 | YES | central spike | 4 |
| GVG01195912 | 25009 | 109: Δ60 | 6 | NO | central spike | 4 |
| GVG01195912 | 25009 | 121: Δ7 | 6 | YES | central spike | 5 |
| GVG01195912 | 25009 | 123: Insert T | 7 | YES | central spike | 5 |
| GVG01195912 | 25009 | 116: Delete CTGTCG | 13 | NO | central spike | 5 |
| GVG01195912 | 25009 | 119: Delete TCGA | 1 | YES | central spike | 5 |
| GVG01195912 | 25009 | 122: Insert A | 45 | YES | central spike | 5 |
| GVG01195912 | 25009 | 122: Delete A | 6 | YES | central spike | 5 |
| GVG01195912 | 25009 | 118: Delete GTCGA | 6 | YES | central spike | 5 |
| GVG01195912 | 25009 | 123: Insert C | 8 | YES | central spike | 5 |
| GVG01195912 | 25009 | 121: Delete GA | 6 | YES | central spike | 5 |
| GVG01195912 | 25009 | 123: Insert T | 10 | YES | central spike | 6 |
| GVG01195912 | 25009 | 111: Δ11 | 7 | YES | central spike | 6 |
| GVG01195912 | 25009 | 119: Delete TCGA | 7 | YES | central spike | 6 |
| GVG01195912 | 25009 | 123: Delete T | 3 | YES | central spike | 6 |
| GVG01195912 | 25009 | 100: Δ27 | 9 | NO | central spike | 6 |
| GVG01195912 | 25009 | 122: Insert A | 28 | YES | central spike | 6 |
| GVG01195912 | 25009 | 123: Insert C | 23 | YES | central spike | 6 |
| GVG01195912 | 25009 | 120: Delete CGA | 1 | NO | central spike | 6 |
| GVG01195912 | 25009 | 115: Δ20 | 1 | YES | central spike | 7 |
| GVG01195912 | 25009 | 123: Insert T | 4 | YES | central spike | 7 |
| GVG01195912 | 25009 | 119: Delete TCGA | 9 | YES | central spike | 7 |
| GVG01195912 | 25009 | 123: Delete T | 29 | YES | central spike | 7 |
| GVG01195912 | 25009 | 123: Insert G | 1 | YES | central spike | 7 |
| GVG01195912 | 25009 | 122: Insert A | 22 | YES | central spike | 7 |
| GVG01195912 | 25009 | 122: Delete A | 3 | YES | central spike | 7 |
| GVG01195912 | 25009 | 103: Δ29 | 2 | YES | central spike | 7 |
| GVG01195912 | 25009 | 121: Delete GA | 5 | YES | central spike | 7 |
| GVG01195912 | 25009 | 123: Delete TC | 7 | YES | central spike | 7 |
| GVG01195912 | 25009 | 120: Delete CGA | 2 | NO | central spike | 7 |
| GVG01195912 | 25009 | 129: Δ48 | 10 | NO | central spike | 7 |
| GVG01195912 | 25009 | 123: Insert T | 2 | YES | central spike | 8 |
| GVG01195912 | 25009 | 121: Δ7 | 7 | YES | central spike | 8 |
| GVG01195912 | 25009 | 139: Insert 25 | 5 | YES | central spike | 8 |
| GVG01195912 | 25009 | 54: Δ48 | 5 | NO | central spike | 8 |
| GVG01195912 | 25009 | 122: Insert A | 3 | YES | central spike | 8 |
| GVG01195912 | 25009 | 112: Δ30 | 20 | NO | central spike | 8 |
| GVG01195912 | 25009 | 122: Delete A | 18 | YES | central spike | 8 |
| GVG01195912 | 25009 | 123: Insert C | 10 | YES | central spike | 8 |
| GVG01195912 | 25009 | 153: Δ60 | 5 | NO | central spike | 8 |
| GVG01195912 | 25009 | 115: Δ9 | 15 | NO | central spike | 8 |
| GVG01195912 | 25009 | 121: Delete GA | 17 | YES | central spike | 8 |
| GVG01195912 | 25009 | 123: Insert T | 17 | YES | central spike | 9 |
| GVG01195912 | 25009 | 103: Δ14 | 3 | YES | central spike | 9 |
| GVG01195912 | 25009 | 119: Delete TCGA | 8 | YES | central spike | 9 |
| GVG01195912 | 25009 | 123: Delete T | 10 | YES | central spike | 9 |
| GVG01195912 | 25009 | 122: Insert A | 29 | YES | central spike | 9 |
| GVG01195912 | 25009 | 122: Delete A | 7 | YES | central spike | 9 |
| GVG01195912 | 25009 | 123: Insert C | 1 | YES | central spike | 9 |
| GVG01195912 | 25009 | 118: Δ10 | 8 | YES | central spike | 9 |
| GVG01195912 | 25009 | 120: Delete CGATC | 3 | YES | central spike | 9 |
| GVG01195912 | 25009 | 57: Δ67 | 9 | YES | central spike | 9 |
| GVG01195912 | 25009 | 115: Δ19 | 5 | YES | central spike | 10 |

TABLE 25-continued

| PlantId | Construct | Variant | % | Frameshift | Location | Position |
|---|---|---|---|---|---|---|
| GVG01195912 | 25009 | 123: Insert T | 5 | YES | central spike | 10 |
| GVG01195912 | 25009 | 121: Insert A | 2 | YES | central spike | 10 |
| GVG01195912 | 25009 | 119: Delete TCGA | 14 | YES | central spike | 10 |
| GVG01195912 | 25009 | 122: Insert A | 40 | YES | central spike | 10 |
| GVG01195912 | 25009 | 123: Delete TC | 5 | YES | central spike | 10 |
| GVG01195912 | 25009 | 116: Δ25 | 27 | YES | central spike | 10 |
| GVG01195912 | 25009 | 123: Insert T | 27 | YES | central spike | 11 |
| GVG01195912 | 25009 | 96: Insert T | 1 | YES | central spike | 11 |
| GVG01195912 | 25009 | 56: Δ22 | 1 | YES | central spike | 11 |
| GVG01195912 | 25009 | 122: Insert A | 22 | YES | central spike | 11 |
| GVG01195912 | 25009 | 122: Delete A | 12 | YES | central spike | 11 |
| GVG01195912 | 25009 | 122: Delete ATCGAG | 1 | NO | central spike | 11 |
| GVG01195912 | 25009 | 112: Δ40 | 1 | YES | central spike | 11 |
| GVG01195912 | 25009 | 101: Insert 26 | 1 | YES | central spike | 11 |
| GVG01195912 | 25009 | 121: Delete GATCGA | 17 | NO | central spike | 11 |
| GVG01195912 | 25009 | 121: Delete GA | 17 | YES | central spike | 11 |
| GVG01195912 | 25009 | 123: Insert T | 1 | YES | central spike | 12 |
| GVG01195912 | 25009 | 108: Δ17 | 3 | YES | central spike | 12 |
| GVG01195912 | 25009 | 119: Delete TCGA | 42 | YES | central spike | 12 |
| GVG01195912 | 25009 | 121: Delete GATCG | 2 | YES | central spike | 12 |
| GVG01195912 | 25009 | 122: Insert A | 13 | YES | central spike | 12 |
| GVG01195912 | 25009 | 122: Delete A | 1 | YES | central spike | 12 |
| GVG01195912 | 25009 | 118: Δ7 | 33 | YES | central spike | 12 |
| GVG01195912 | 25009 | 121: Delete GA | 3 | YES | central spike | 12 |
| GVG01195912 | 25009 | 123: Insert T | 9 | YES | side branch 1 | 1 |
| GVG01195912 | 25009 | 119: Delete TCGA | 44 | YES | side branch 1 | 1 |
| GVG01195912 | 25009 | 122: Insert A | 3 | YES | side branch 1 | 1 |
| GVG01195912 | 25009 | 120: Delete CGATC | 7 | YES | side branch 1 | 1 |
| GVG01195912 | 25009 | 118: Δ7 | 19 | YES | side branch 1 | 1 |
| GVG01195912 | 25009 | 111: Δ10 | 9 | YES | side branch 1 | 2 |
| GVG01195912 | 25009 | 123: Insert T | 23 | YES | side branch 1 | 2 |
| GVG01195912 | 25009 | 123: Insert C | 9 | YES | side branch 1 | 2 |
| GVG01195912 | 25009 | 119: Delete TCGA | 13 | YES | side branch 1 | 2 |
| GVG01195912 | 25009 | 122: Insert A | 17 | YES | side branch 1 | 2 |
| GVG01195912 | 25009 | 122: Delete A | 12 | YES | side branch 1 | 2 |
| GVG01195912 | 25009 | 122: Insert AA | 13 | YES | side branch 1 | 2 |
| GVG01195912 | 25009 | 123: Insert C | 6 | YES | side branch 1 | 3 |
| GVG01195912 | 25009 | 119: Delete TCGA | 15 | YES | side branch 1 | 3 |
| GVG01195912 | 25009 | 123: Delete T | 1 | YES | side branch 1 | 3 |
| GVG01195912 | 25009 | 122: Insert A | 32 | YES | side branch 1 | 3 |
| GVG01195912 | 25009 | 121: Delete GA | 17 | YES | side branch 1 | 3 |
| GVG01195912 | 25009 | 122: Insert AA | 23 | YES | side branch 1 | 3 |
| GVG01195912 | 25009 | 118: Δ7 | 3 | YES | side branch 1 | 3 |
| GVG01195912 | 25009 | 123: Insert T | 2 | YES | side branch 1 | 4 |
| GVG01195912 | 25009 | 122: Insert G | 2 | YES | side branch 1 | 4 |
| GVG01195912 | 25009 | 119: Delete TCGA | 15 | YES | side branch 1 | 4 |
| GVG01195912 | 25009 | 123: Delete T | 16 | YES | side branch 1 | 4 |
| GVG01195912 | 25009 | 121: Δ48 | 1 | NO | side branch 1 | 4 |
| GVG01195912 | 25009 | 122: Insert A | 43 | YES | side branch 1 | 4 |
| GVG01195912 | 25009 | 122: Delete A | 3 | YES | side branch 1 | 4 |
| GVG01195912 | 25009 | 122: Insert AA | 5 | YES | side branch 1 | 4 |
| GVG01195912 | 25009 | 117: Delete TGTCGA | 11 | NO | side branch 1 | 4 |
| GVG01195912 | 25009 | 123: Insert T | 7 | YES | side branch 1 | 5 |
| GVG01195912 | 25009 | 112: Δ40 | 2 | YES | side branch 1 | 5 |
| GVG01195912 | 25009 | 119: Delete TCGA | 14 | YES | side branch 1 | 5 |
| GVG01195912 | 25009 | 122: Insert A | 58 | YES | side branch 1 | 5 |
| GVG01195912 | 25009 | 121: Delete GA | 9 | YES | side branch 1 | 5 |
| GVG01195912 | 25009 | 123: Delete TC | 7 | YES | side branch 1 | 5 |
| GVG01195912 | 25009 | 123: Insert T | 10 | YES | side branch 1 | 6 |
| GVG01195912 | 25009 | 113: Δ10 | 2 | YES | side branch 1 | 6 |
| GVG01195912 | 25009 | 119: Delete TCGA | 43 | YES | side branch 1 | 6 |
| GVG01195912 | 25009 | 121: Delete GAT | 3 | NO | side branch 1 | 6 |
| GVG01195912 | 25009 | 122: Insert A | 11 | YES | side branch 1 | 6 |
| GVG01195912 | 25009 | 122: Delete A | 9 | YES | side branch 1 | 6 |
| GVG01195912 | 25009 | 101: Δ24 | 11 | NO | side branch 1 | 6 |
| GVG01195912 | 25009 | 122: Insert 17 | 5 | YES | side branch 1 | 6 |
| GVG01195912 | 25009 | 120: Delete CGATC | 3 | YES | side branch 1 | 6 |
| GVG01195912 | 25009 | 121: Delete GA | 1 | YES | side branch 1 | 6 |
| GVG01195912 | 25009 | 119: Delete TCGA | 1 | YES | side branch 2 | 1 |
| GVG01195912 | 25009 | 122: Insert A | 49 | YES | side branch 2 | 1 |
| GVG01195912 | 25009 | 121: Delete GA | 34 | YES | side branch 2 | 1 |
| GVG01195912 | 25009 | 123: Delete TC | 11 | YES | side branch 2 | 1 |
| GVG01195912 | 25009 | 123: Delete T | 5 | YES | side branch 2 | 2 |
| GVG01195912 | 25009 | 119: Delete TCGA | 13 | YES | side branch 2 | 2 |
| GVG01195912 | 25009 | 117: Δ15 | 2 | NO | side branch 2 | 2 |
| GVG01195912 | 25009 | 122: Insert A | 16 | YES | side branch 2 | 2 |
| GVG01195912 | 25009 | 122: Delete A | 2 | YES | side branch 2 | 2 |
| GVG01195912 | 25009 | 123: Insert C | 11 | YES | side branch 2 | 2 |

TABLE 25-continued

| PlantId | Construct | Variant | % | Frameshift | Location | Position |
|---|---|---|---|---|---|---|
| GVG01195912 | 25009 | 115: Δ14 | 23 | YES | side branch 2 | 2 |
| GVG01195912 | 25009 | 112: Δ13 | 25 | YES | side branch 2 | 2 |
| GVG01195912 | 25009 | 109: Δ15 | 2 | NO | side branch 2 | 3 |
| GVG01195912 | 25009 | 119: Delete TCGA | 9 | YES | side branch 2 | 3 |
| GVG01195912 | 25009 | 122: Insert A | 40 | YES | side branch 2 | 3 |
| GVG01195912 | 25009 | 122: Delete A | 27 | YES | side branch 2 | 3 |
| GVG01195912 | 25009 | 122: Insert C | 6 | YES | side branch 2 | 3 |
| GVG01195912 | 25009 | 111: Δ15 | 3 | NO | side branch 2 | 3 |
| GVG01195912 | 25009 | 123: Insert C | 1 | YES | side branch 2 | 3 |
| GVG01195912 | 25009 | 121: Delete GA | 3 | YES | side branch 2 | 3 |
| GVG01195912 | 25009 | 123: Insert T | 2 | YES | side branch 2 | 4 |
| GVG01195912 | 25009 | 119: Delete TCGA | 17 | YES | side branch 2 | 4 |
| GVG01195912 | 25009 | 123: Insert G | 5 | YES | side branch 2 | 4 |
| GVG01195912 | 25009 | 122: Insert A | 67 | YES | side branch 2 | 4 |
| GVG01195912 | 25009 | 121: Delete GA | 3 | YES | side branch 2 | 4 |
| GVG01195912 | 25009 | 122: Delete A | 1 | YES | side branch 2 | 4 |
| GVG01195912 | 25009 | 123: Insert T | 72 | YES | side branch 2 | 5 |
| GVG01195912 | 25009 | 119: Delete TCGA | 11 | YES | side branch 2 | 5 |
| GVG01195912 | 25009 | 100: Δ27 | 1 | NO | side branch 2 | 5 |
| GVG01195912 | 25009 | 122: Insert A | 5 | YES | side branch 2 | 5 |
| GVG01195912 | 25009 | 121: Delete GA | 7 | YES | side branch 2 | 5 |
| GVG01195912 | 25009 | 119: Delete TCGA | 3 | YES | side branch 2 | 6 |
| GVG01195912 | 25009 | 122: Insert A | 51 | YES | side branch 2 | 6 |
| GVG01195912 | 25009 | 121: Delete GA | 39 | YES | side branch 2 | 6 |
| GVG01195912 | 25009 | 122: Delete A | 3 | YES | side branch 2 | 6 |
| GVG01195912 | 25009 | 120: Delete CGATCG | 34 | NO | side branch 3 | 1 |
| GVG01195912 | 25009 | 123: Delete T | 36 | YES | side branch 3 | 1 |
| GVG01195912 | 25009 | 74: Δ49 | 4 | YES | side branch 3 | 1 |
| GVG01195912 | 25009 | 123: Insert G | 1 | YES | side branch 3 | 1 |
| GVG01195912 | 25009 | 121: Delete GAT | 1 | NO | side branch 3 | 1 |
| GVG01195912 | 25009 | 122: Insert A | 19 | YES | side branch 3 | 1 |
| GVG01195912 | 25009 | 120: Delete C | 8 | YES | side branch 3 | 2 |
| GVG01195912 | 25009 | 119: Delete TCGA | 1 | YES | side branch 3 | 2 |
| GVG01195912 | 25009 | 123: Delete T | 13 | YES | side branch 3 | 2 |
| GVG01195912 | 25009 | 74: Δ49 | 2 | YES | side branch 3 | 2 |
| GVG01195912 | 25009 | 121: Delete GAT | 11 | NO | side branch 3 | 2 |
| GVG01195912 | 25009 | 123: Delete TCG | 3 | NO | side branch 3 | 2 |
| GVG01195912 | 25009 | 122: Insert A | 20 | YES | side branch 3 | 2 |
| GVG01195912 | 25009 | 115: Δ8 | 38 | YES | side branch 3 | 2 |
| GVG01195912 | 25009 | 120: Δ14 | 36 | YES | side branch 3 | 3 |
| GVG01195912 | 25009 | 119: Delete TCGA | 13 | YES | side branch 3 | 3 |
| GVG01195912 | 25009 | 123: Delete T | 13 | YES | side branch 3 | 3 |
| GVG01195912 | 25009 | 122: Insert A | 15 | YES | side branch 3 | 3 |
| GVG01195912 | 25009 | 123: Insert GG | 12 | YES | side branch 3 | 3 |
| GVG01195912 | 25009 | 122: Delete A | 8 | YES | side branch 3 | 3 |
| GVG01195912 | 25009 | 119: Delete TCGA | 35 | YES | side branch 3 | 4 |
| GVG01195912 | 25009 | 121: Δ48 | 43 | NO | side branch 3 | 4 |
| GVG01195912 | 25009 | 121: Delete GAT | 5 | NO | side branch 3 | 4 |
| GVG01195912 | 25009 | 122: Insert A | 9 | YES | side branch 3 | 4 |
| GVG01195912 | 25009 | 121: Delete GA | 5 | YES | side branch 3 | 4 |
| GVG01195912 | 25009 | 123: Insert T | 6 | YES | side branch 3 | 5 |
| GVG01195912 | 25009 | 121: Δ7 | 10 | YES | side branch 3 | 5 |
| GVG01195912 | 25009 | 119: Delete TCGA | 36 | YES | side branch 3 | 5 |
| GVG01195912 | 25009 | 44: Δ46 | 10 | YES | side branch 3 | 5 |
| GVG01195912 | 25009 | 122: Insert A | 8 | YES | side branch 3 | 5 |
| GVG01195912 | 25009 | 120: Delete CGA | 11 | NO | side branch 3 | 5 |
| GVG01195912 | 25009 | 122: Delete A | 25 | YES | side branch 3 | 5 |
| GVG01195912 | 25009 | 123: Insert C | 38 | YES | side branch 3 | 6 |
| GVG01195912 | 25009 | 119: Delete TCGA | 6 | YES | side branch 3 | 6 |
| GVG01195912 | 25009 | 122: Insert A | 11 | YES | side branch 3 | 6 |
| GVG01195912 | 25009 | 121: Delete GA | 42 | YES | side branch 3 | 6 |
| GVG01195912 | 25009 | 123: Insert T | 15 | YES | side branch 4 | 1 |
| GVG01195912 | 25009 | 113: Δ20 | 44 | YES | side branch 4 | 1 |
| GVG01195912 | 25009 | 122: Insert A | 35 | YES | side branch 4 | 1 |
| GVG01195912 | 25009 | 118: Delete GTCGA | 7 | YES | side branch 4 | 2 |
| GVG01195912 | 25009 | 123: Insert C | 30 | YES | side branch 4 | 2 |
| GVG01195912 | 25009 | 119: Delete TCGA | 11 | YES | side branch 4 | 2 |
| GVG01195912 | 25009 | 123: Delete T | 31 | YES | side branch 4 | 2 |
| GVG01195912 | 25009 | 122: Insert A | 6 | YES | side branch 4 | 2 |
| GVG01195912 | 25009 | 121: Insert CGAA | 6 | YES | side branch 4 | 2 |
| GVG01195912 | 25009 | 120: Delete CGATC | 6 | YES | side branch 4 | 2 |
| GVG01195912 | 25009 | 114: Δ10 | 32 | YES | side branch 4 | 3 |
| GVG01195912 | 25009 | 123: Insert T | 2 | YES | side branch 4 | 3 |
| GVG01195912 | 25009 | 123: Insert C | 6 | YES | side branch 4 | 3 |
| GVG01195912 | 25009 | 119: Delete TCGA | 11 | YES | side branch 4 | 3 |
| GVG01195912 | 25009 | 123: Delete T | 30 | YES | side branch 4 | 3 |
| GVG01195912 | 25009 | 122: Insert A | 14 | YES | side branch 4 | 3 |
| GVG01195912 | 25009 | 24: Δ65 | 6 | YES | side branch 4 | 3 |

TABLE 25-continued

| PlantId | Construct | Variant | % | Frameshift | Location | Position |
|---|---|---|---|---|---|---|
| GVG01195912 | 25009 | 123: Insert T | 10 | YES | side branch 4 | 4 |
| GVG01195912 | 25009 | 123: Insert C | 14 | YES | side branch 4 | 4 |
| GVG01195912 | 25009 | 119: Delete TCGA | 14 | YES | side branch 4 | 4 |
| GVG01195912 | 25009 | 122: Insert A | 59 | YES | side branch 4 | 4 |
| GVG01195912 | 25009 | 123: Insert T | 1 | YES | side branch 4 | 5 |
| GVG01195912 | 25009 | 123: Insert C | 14 | YES | side branch 4 | 5 |
| GVG01195912 | 25009 | 122: Insert A | 3 | YES | side branch 4 | 5 |
| GVG01195912 | 25009 | 121: Delete GA | 39 | YES | side branch 4 | 5 |
| GVG01195912 | 25009 | 122: Delete A | 40 | YES | side branch 4 | 5 |
| GVG01195912 | 25009 | 123: Insert C | 5 | YES | side branch 4 | 6 |
| GVG01195912 | 25009 | 119: Delete TCGA | 24 | YES | side branch 4 | 6 |
| GVG01195912 | 25009 | 123: Insert G | 6 | YES | side branch 4 | 6 |
| GVG01195912 | 25009 | 117: Delete T | 29 | YES | side branch 4 | 6 |
| GVG01195912 | 25009 | 122: Insert A | 26 | YES | side branch 4 | 6 |
| GVG01195912 | 25009 | 122: Delete A | 7 | YES | side branch 4 | 6 |

Figure 39:
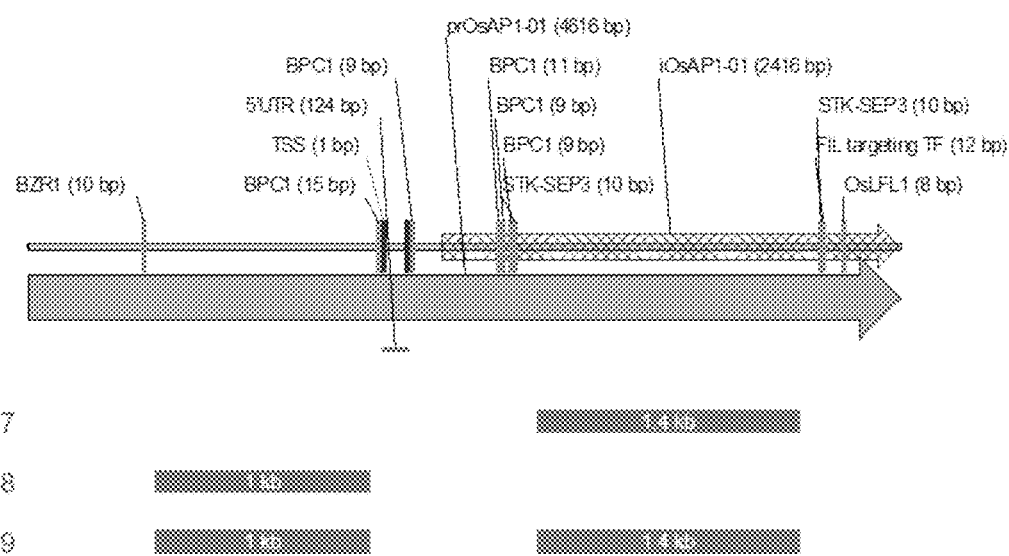

In summary, shortened promoter prOsAP1-01 maintained FMOS activity. FIG. 39 shows the shortening of promoter prOsAP1 in construct 25007 (4.9 average mosaicism score); in construct 25008 (4.9 average mosaicism score); and in construct 25009 (6.0 average mosaicism score). These are good performances compared to the baseline for construct 24460, which was 6.0.

By way of another example, prZmAP1-01 (SEQ ID NO: 2) was modified to remove domains that lacked notable floral transcription factor binding motifs and that were in the promoter. To test whether these domains were dispensable to FMOS activity, we removed them and then rebuilt the constructs and retested them through the exact same process as described in examples 2 and 3. For example, we built promoter prZmAP1-03 (SEQ ID NO: 614) by removing 1,746 bp (46%) from the prZmAP1-01 promoter for construct 24997 (SEQ ID NO: 537). We produced 11 events, and 8 had scores of "2" in leaf Taqman assay (i.e. they were not edited), of which 5 looked unedited at the tassel stage by ADH1 pollen evaluation (See Table 26 below), while three events looked like they had FMOS activity. In addition, one event had a "0" for the leaf Taqman and had pollen ADH1 staining that looked like a constitutive promoter (all samples were "0"). Two events had a score of "1" in the leaf assay.

Table 26 show ADH1 staining data for the eleven events from construct 24997 (shortened prZmAP1). The scores represent the proportion of pollen grains for each sample that were positive for ADH1 staining.

TABLE 26

|  | 1 | 2 | 3 | 4 | 5 | 6 | 7 | 8 | 9 | 10 | 11 | 12 |  |
|---|---|---|---|---|---|---|---|---|---|---|---|---|---|
| A | 0 | 0 | 0 | 0 | 0 | 0 | 0 | 0 | 0 | 0 | 0 | 0 | 24997 |
| B | 0 | 0 | 0 | 0 | 0 | 0 |  |  |  |  |  |  | GVG01189788 |
| D control | 80 | 90 | 90 | 90 | 90 | 90 | 90 | 90 | 90 | 90 | 90 | 90 | Taqman = 0 |
| E | 70 | 30 | 25 | 25 | 60 | 30 | 40 | 60 | 10 | 30 | 30 | 20 | 24997 |
| F | 30 | 40 | 25 | 60 | 10 | 50 | 15 | 10 | 20 | 25 | 20 | 50 | GVG01189790 |
| G | 25 | 25 | 15 | 20 | 15 | 20 | 20 | 40 | 60 | 50 | 25 | 45 | Taqman = 1 |
| A | 80 | 75 | 75 | 90 | 90 | 90 | 90 | 90 | 90 | 75 | 75 | 75 | 24997 |
| B | 60 | 60 | 75 | 80 | 80 | 80 | 75 | 75 | 75 | 75 | 60 | 60 | GVG01189791 |
|  |  |  |  |  |  |  |  |  |  |  |  |  | Taqman = 2 |
| E | 95 | 95 | 90 | 95 | 95 | 90 | 90 | 90 | 95 | 95 | 95 | 95 | 24997 |
| F | 80 | 90 | 95 | 90 | 80 | 75 |  |  |  |  |  |  | GVG01189789 |
| H control | 90 | 90 | 90 | 90 | 85 | 85 | 90 | 95 | 90 | 90 | 90 | 95 | Taqman = 2 |
| A | 15 | 15 | 10 | 15 | 25 | 20 | 25 | 20 | 15 | 15 | 20 | 25 | 24997 |
| B | 15 | 20 | 25 | 20 | 20 | 15 | 15 | 20 | 25 | 10 | 10 | 20 | GVG01189786 |
| C | 20 | 20 | 25 | 25 | 25 | 20 |  |  |  |  |  |  | Taqman = 2 |
| E | 1 | 0 | 0 | 0 | 1 | 5 | 1 | 1 | 1 | 1 | 5 | 1 | 24997 |
| F | 0 | 1 | 0 | 1 | 0 | 0 | 5 | 0 | 0 | 5 | 1 | 10 | GVG01189784 |
|  |  |  |  |  |  |  |  |  |  |  |  |  | Taqman = 2 |
| A | 85 | 80 | 80 | 85 | 90 | 80 | 85 | 90 | 85 | 80 | 85 | 90 | 24997 |
| B | 80 | 70 | 85 | 80 | 80 | 80 | 85 | 85 | 90 | 85 | 90 | 90 | GVG01189780 |
| D control | 95 | 90 | 90 | 90 | 95 | 95 | 90 | 95 | 90 | 95 | 90 | 90 | Taqman = 2 |
| E | 70 | 70 | 75 | 70 | 80 | 80 | 90 | 90 | 85 | 75 | 75 | 70 | 24997 |
| F | 75 | 80 | 75 | 80 | 70 | 65 | 70 | 75 | 80 | 75 | 80 | 80 | GVG01189782 |
| G | 80 | 80 | 80 | 90 | 80 | 50 | 65 | 70 | 70 | 65 | 65 | 60 | Taqman = 2 |
| A | 0 | 0 | 0 | 0 | 0 | 0 | 0 | 0 | 0 | 1 | 0 | 0 | 24997 |
| B | 0 | 0 | 0 | 0 | 0 | 0 | 1 | 1 | 0 | 0 | 0 | 0 | GVG01189781 |
| D control | 90 | 85 | 80 | 90 | 90 | 85 | 90 | 90 | 95 | 90 | 85 | 90 | Taqman = 2 |
| E | 1 | 1 | 1 | 1 | 1 | 2 | 1 | 0 | 1 | 0 | 0 | 2 | 24997 |
| F | 1 | 0 | 0 | 0 | 0 | 1 | 0 | 1 | 1 | 0 | 0 | 1 | GVG01189787 |
| G | 0 | 1 | 1 | 0 | 0 | 0 | 0 | 0 | 1 | 0 | 0 | 0 | Taqman = 1 |
| A | 95 | 90 | 75 | 90 | 85 | 85 | 90 | 90 | 90 | 95 | 85 | 90 | 24997 |
| B | 80 | 90 | 85 | 90 | 90 | 95 | 95 | 90 | 80 | 90 | 80 | 90 | GVG01192961 |
| D control |  |  |  |  |  |  | 95 | 95 | 97 | 97 | 95 | 90 | Taqman = 2 |

The three events GVG01189786, GVG01189784, and GVG01189781 had a "2" score and good FMOS apparent activity by ADH1 pollen staining. The latter two were sent to tassel spikelet NGS and T1 offspring analysis. In addition, event GVG01189790 which had a "1" Taqman assay score (heterozygous) and maintained FMOS activity by ADH1 staining was subjected to tassel spikelet NGS. The mosaicism score of the three events were similar, though GVG01189790 was the lowest (4.33), followed by the ones that had better FMOS indicators in the T0 stage (GVG01189781 was 4.75 and GVG01189784 was 5.58). In the T1 analysis, numerous diverse edits were seen from the offspring of each of those two events. These are similar values to what was seen for the original prZmAP1-01.

Comparing the mosaicism scores of the original promoters to their shortened versions (FIG. 26c), you can see that the scores between prZmAP1-01 (construct 24301) and the shortened prZmAP1-03 (construct 24997) did not change; the scores between prZmBde1-02 and prZmBde1-03 and -07 (25002 and 25006 respectively) did not change, while the score of prZmBde1-04 (25003) dropped slightly; the scores between prOsAP1-01 (24460) and prOsAP1-02, -03, and -04 (25007, 25008, and 25009 respectively) did not change much, with just a slight drop in 25008.

Figure 26D:
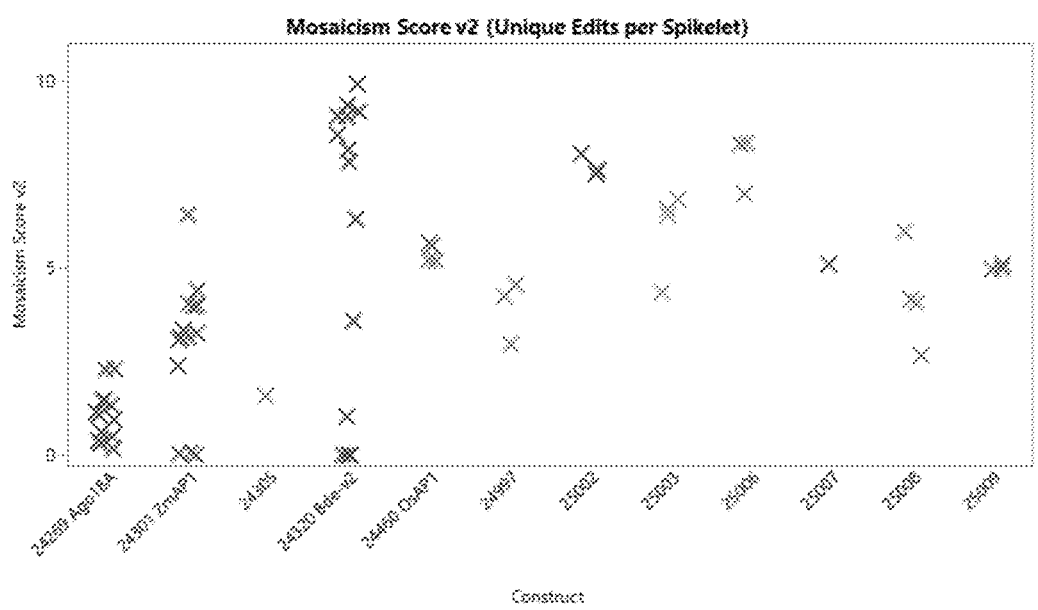
FIG. 26d is a graph showing mosaicism scores for various constructs.

We also recalculated mosaicism scores using a different formula (Mosaicism Methodology 2), to recheck the results for all of the constructs' NGS data sets. As before, we used the tassel maps for each allele type (or editing type). Starting from the bottom of each spike, the first mutation was always counted as a unique mutation. Moving upwards from the first mutation, other mutations only counted if the mutation abundance differed by more than 15% from the previous spikelet sample. Mutations with abundances <10% were also subject to that rule (previously, they were excluded from that rule; see example 4). For each event, the total number of independent edits was calculated (across all edits), and the resulting value was divided by the total number of samples evaluated by NGS. This 'mosaicism score' therefore represents the average number of unique edits per spikelet sample. A mosaicism score is calculated for each event. The mosaicism scores using Mosaicism Methodology 2 (which is more conservative and likely undercounts the actual editing diversity) are shown in FIG. 26d—the general trend is the same as before. Table 26d shows mosaicism scores using Mosaicism Methodology 2 that subjects edits with <10% abundance to the <15% adjacency rule (see above and example 4 for explanation). All mosaicism scores in the claims are calculated using Mosaicism Methodology 1, unless specifically indicated otherwise.

Detailed descriptions of exemplary vector constructs containing expression cassettes according to various embodiments of the invention are provided below.

| Position by bp | Component name | Description |
| --- | --- | --- |
| | | 24997: Binary vector for testing a shortened version of maize Apetala1 promoter. Identical to 24301 except that the prZmAP1-01 that drives Cas9 expression was replaced with shortened prZmAP1-03. The sgRNA still targets the maize ADH1 gene. |
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |
| 184-195 | xSTOPS-01 | 6-frame stop to minimize unintended ORF read-through |
| 232-2257 | prZmAP1-03 | A shortened version of the promoter of maize APETALA1 (AP1) gene (Zm00001d007949, GRMZM2G148693, Agamous-like MADS-box protein AGL8) from B73v5. Removed 1,746 bp from prZmAP1-01. |
| 1157-2256 | iZmAP1-03 | A shortened version of the intron in the maize APETALA1 (AP1) promoter (Zm00001d007949, GRMZM2G148693, Agamous-like MADS-box protein AGL8) from B73v5. Removed 1,746 bp from iZmAP1-01 (from 1,001 to 2,746). |
| 2264-6433 | cCas9-02 | *Streptococcus pyogenes* Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 6445-7444 | tZmAP1-01 | Terminator sequence of maize APETALA1 (AP1) gene (Zm00001d007949) from B73v5. |
| 7457-7831 | prOsU3-01 | Rice U3 promoterfor pol III dependent transcription of non-coding RNAs |
| 7832-7937 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 7964-9956 | prUbi1-18 | prUbil-10 (Ubiquitin promoter from *Zea mays* from Mycogen) with T to C at nt597, G to A at nt1047, C to T at nt1117 |
| 9969-11144 | cPMI-01 | *E. coli* manA gene encoding phosphomannose isomerase |
| 11183-12217 | tUbi1-04 | The terminator from the UBI1 gene from *Zea mays*. optimized to remove internal SbfI site |
| 12240-12251 | xSTOPS-01 | 6-frame stop to minimize unintended ORF read-through |
| 12252-12291 | xTAG-02 | 40 bp site for plant insert intactness testing and to stop readthrough ORFs. Typically by agro LB. |
| 12300-12429 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 12709-13497 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |

| Position by bp | Component name | Description |
|---|---|---|
| 13592-13722 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 13797-14522 | cVirG-01 | virG (putative) from pAD1289 with TTG start codon. virGN54D came from pAD1289 described in Hansen et al. 1994, PNAS 91: 7603-7607 |
| 14552-15625 | cRepA-03 | cRepA-01 (pVS1 replication protein) with A to G at nt735 |
| 15668-16072 | oVS1-02 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |
| 16750-17556 | oCOLE-06 | The ColE1 origin of replication functional in *E. coli* derived from pUC19 |

25002: Binary vector for testing a shortened version of maize Bearded Ear1 (Bde1) gene promoter. Identical to 24320 except that the prZmBde1-02 that drives Cas9 expression was replaced with a shortened version prZmBde1-03. The sgRNA still targets the maize ADH1 gene.

| Position by bp | Component name | Description |
|---|---|---|
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |
| 184-195 | xSTOPS-01 | 6-frame stop to minimize unintended ORF read-through |
| 231-4272 | prZmBde1-03 | A shortened version of the promoter of maize Bearded Ear1 gene (Zm00001d017614) from B73v5. Removed 1,746 bp from prZmBde1-02. Removed 1,696 bp from the intron (iZmBde1-01) within prZmBde1-02. |
| 2622-4257 | iZmBde1-02 | A shortened version of the first intron in the maize Bearded Ear1 gene (Zm00001d017614) from B73v5. Removed 1,696 bp from iZmBde1-01 (from 3,233 to 4,928). |
| 4279-8448 | cCas9-02 | Streptococcus pyogenes Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 8456-9607 | tZmBde1-01 | The terminator sequence of maize Bearded Ear1 gene (Zm00001d017614) from B73v5. |
| 9614-9988 | prOsU3-01 | Rice U3 promoterfor pol III dependent transcription of non-coding RNAs |
| 9989-10094 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 10121-12113 | prUbi1-18 | prUbi1-10 (Ubiquitin promoter from *Zea mays* from Mycogen) with T to C at nt597, G to A at nt1047, C to T at nt1117 |
| 12126-13301 | cPMI-01 | *E. coli* manA gene encoding phosphomannose isomerase |
| 13340-14374 | tUbi1-04 | The terminator from the UBI1 gene from *Zea mays*, optimized to remove internal SbfI site |
| 14397-14408 | xSTOPS-01 | 6-frame stop to minimize unintended ORF read-through |
| 14409-14448 | xTAG-02 | 40 bp site for plant insert intactness testing and to stop readthrough ORFs. Typically by agro LB. |
| 14457-14586 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 14866-15654 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 15748-15879 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 15954-16679 | cVirG-01 | virG (putative) from pAD1289 with TTG start codon. virGN54D came from pAD1289 described in Hansen et al. 1994, PNAS 91: 7603-7607 |
| 16709-17782 | cRepA-03 | cRepA-01 (pVS1 replication protein) with A to G at nt735 |
| 17825-18229 | oVS1-02 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |
| 18907-19713 | oCOLE-06 | The ColE1 origin of replication functional in *E. coli* derived from pUC19 |

25003: Binary vector for testing a shortened version of maize Bearded Ear1 (Bde1) gene promoter. Identical to 24320 except that the prZmBde1-02 that drives Cas9 expression was replaced with a shortened version prZmBde1-04. The sgRNA still targets the maize ADH1 gene.

| Position by bp | Component name | Description |
|---|---|---|
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |
| 184-195 | xSTOPS-01 | 6-frame stop to minimize unintended ORF read-through |
| 231-3631 | prZmBde1-04 | A shortened version of the promoter of maize Bearded Ear1 gene (Zm00001d017614) from B73v5. Removed 1,746 bp from prZmBde1-02. Removed 2,337 bp from the intron (iZmBde1-01) within prZmBde1-02. |

| Position by bp | Component name | Description |
| --- | --- | --- |
| 2622-3616 | iZmBde1-03 | A shortened version of the first intron in the maize Bearded Ear1 gene (Zm00001d017614) from B73v5. Removed 1,696 bp from iZmBde1-01 (from 201 to 2,538). |
| 3638-7807 | cCas9-02 | Streptococcus pyogenes Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 7815-8966 | tZmBde1-01 | The terminator sequence of maize Bearded Ear1 gene (Zm00001d017614) from B73v5. |
| 8973-9347 | prOsU3-01 | Rice U3 promoterfor pol III dependent transcription of non-coding RNAs |
| 9348-9453 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 9480-11472 | prUbi1-18 | prUbi1-10 (Ubiquitin promoter from Zea mays from Mycogen) with T to C at nt597, G to A at nt1047, C to T at nt1117 |
| 11485-12660 | cPMI-01 | E. coli manA gene encoding phosphomannose isomerase |
| 12699-13733 | tUbi1-04 | The terminator from the UBI1 gene from Zea mays, optimized to remove internal SbfI site |
| 13756-13767 | xSTOPS-01 | 6-frame stop to minimize unintended ORF read-through |
| 13768-13807 | xTAG-02 | 40 bp site for plant insert intactness testing and to stop readthrough ORFs. Typically by agro LB. |
| 13816-13945 | bNLB-05 | Left border region of T-DNA of Agrobacterium tumefaciens nopaline ti-plasmid. Differs from bNLB-03 by one base pair to remove ATG start codon for ORF pointing into flanking region. |
| 14225-15013 | cSpec-03 | Also called aadA; gene encoding the enzyme aminoglycoside 3'adenyltransferase that confers resistance to spectinomycin and streptomycin for maintenance of the vector in E. coli and Agrobacterium. aka cSPEC-03 |
| 15108-15238 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 15313-16038 | cVirG-01 | virG (putative) from pAD1289 with TTG start codon. virGN54D came from pAD1289 described in Hansen et al. 1994, PNAS 91: 7603-7607 |
| 16068-17141 | cRepA-03 | cRepA-01 (pVS1 replication protein) with A to G at nt735 |
| 17184-17588 | oVS1-02 | origin of replication and partitioning region from plasmid pVS1 of Pseudomonas (Itoh et al. 1984, Plasmid 11: 206-220); similar to GenBank Accession Number U10487; serves as origin of replication in Agrobacterium tumefaciens host |
| 18266-19072 | oCOLE-06 | The ColE1 origin of replication functional in E. coli derived from pUC19 25004: Binary vector for testing a shortened version of maize Bearded Ear1 (Bde1) gene promoter. Identical to 24320 except that the prZmBde1-02 that drives Cas9 expression was replaced with a shortened version prZmBde1-05. The sgRNA still targets the maize ADH1 gene. |
| 4-143 | bNRB-04 | Right border region of T-DNA of Agrobacterium tumefaciens nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |
| 184-195 | xSTOPS-01 | 6-frame stop to minimize unintended ORF read-through |
| 231-3677 | prZmBde1-05 | A shortened version of the promoter of maize Bearded Ear1 gene (Zm00001d017614) from B73v5. Removed 1,746 bp from prZmBde1-02. Removed 2,291 bp from the intron (iZmBde1-01) within prZmBde1-02. |
| 2622-3662 | iZmBde1-04 | A shortened version of the first intron in the maize Bearded Ear1 gene (Zm00001d017614) from B73v5. Removed 2,291 bp from iZmBde1-01 (from 842 to 3,132). |
| 3684-7853 | cCas9-02 | Streptococcus pyogenes Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 7861-9012 | tZmBde1-01 | The terminator sequence of maize Bearded Ear1 gene (Zm00001d017614) from B73v5. |
| 9019-9393 | prOsU3-01 | Rice U3 promoterfor pol III dependent transcription of non-coding RNAs |
| 9394-9499 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 9526-11518 | prUbi1-18 | prUbi1-10 (Ubiquitin promoter from Zea mays from Mycogen) with T to C at nt597, G to A at nt1047, C to T at nt1117 |
| 11531-12706 | cPMI-01 | E. coli manA gene encoding phosphomannose isomerase |
| 12745-13779 | tUbi1-04 | The terminator from the UBI1 gene from Zea mays. optimized to remove internal SbfI site |
| 13802-13813 | xSTOPS-01 | 6-frame stop to minimize unintended ORF read-through |
| 13814-13853 | xTAG-02 | 40 bp site for plant insert intactness testing and to stop readthrough ORFs. Typically by agro LB. |
| 13862-13991 | bNLB-05 | Left border region of T-DNA of Agrobacterium tumefaciens nopaline ti-plasmid. Differs from bNLB-03 by one base pair to remove ATG start codon for ORF pointing into flanking region. |

-continued

| Position by bp | Component name | Description |
|---|---|---|
| 14271-15059 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 15154-15284 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 15359-16084 | cVirG-01 | virG (putative) from pAD1289 with TTG start codon. virGN54D came from pAD1289 described in Hansen et al. 1994, PNAS 91: 7603-7607 |
| 16114-17187 | cRepA-03 | cRepA-01 (pVS1 replication protein) with A to G at nt735 |
| 17230-17634 | oVS1-02 | origin of replication and partitioning region from plasmid pVSl of Pseudomonas (Itoh et al. 1984, Plasmid 11: 206-220); similar to GenBank Accession Number U10487; serves as origin of replication in *Agrobacterium tumefaciens* host |
| 18312-19118 | oCOLE-06 | The ColE1 origin of replication functional in *E. coli* derived from pUC19 |
| | | 25005: Binary vector for testing a shortened version of maize Bearded Earl (Bde1) gene promoter. Identical to 24320 except that the prZmBde1-02 that drives Cas9 expression was replaced with a shortened version prZmBde1-06. The sgRNA still targets the maize ADH1 gene. |
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |
| 184-195 | xSTOPS-01 | 6-frame stop to minimize unintended ORF read-through |
| 231-5668 | prZmBde1-06 | A shortened version of the promoter of maize Bearded Earl gene (Zm00001d017614) from B73v5. The first 300 bp of prZmBde1-02 was removed. |
| 2322-5653 | iZmBde1-01 | first intron of maize Bearded Earl gene (Zm00001d017614) from B73v5 removed. |
| 5675-9844 | cCas9-02 | Streptococcus pyogenes Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 9852-11003 | tZmBde1-01 | The terminator sequence of maize Bearded Earl gene (Zm00001d017614) from B73v5. |
| 11010-11384 | prOsU3-01 | Rice U3 promoterfor pol III dependent transcription of non-coding RNAs |
| 11385-11490 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 11517-13509 | prUbi1-18 | prUbi1-10 (Ubiquitin promoter from *Zea mays* from Mycogen) with T to C at nt597, G to A at nt1047, C to T at nt1117 |
| 13522-14697 | cPMI-01 | *E. coli* manA gene encoding phosphomannose isomerase |
| 14736-15770 | tUbi1-04 | The terminator from the UBI1 gene from *Zea mays*. optimized to remove internal SbfI site |
| 15793-15804 | xSTOPS-01 | 6-frame stop to minimize unintended ORF read-through |
| 15805-15844 | xTAG-02 | 40 bp site for plant insert intactness testing and to stop readthrough ORFs. Typically by agro LB. |
| 15853-15982 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 16262-17050 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 17145-17275 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 17350-18075 | cVirG-01 | virG (putative) from pAD1289 with TTG start codon. virGN54D came from pAD1289 described in Hansen et al. 1994, PNAS 91: 7603-7607 |
| 18105-19178 | cRepA-03 | cRepA-01 (pVS1 replication protein) with A to G at nt735 |
| 19221-19625 | oVS1-02 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |
| 20303-21109 | oCOLE-06 | The ColE1 origin of replication functional in *E. coli* derived from pUC19 |
| | | 25006: Binary vector for testing a shortened version of maize Bearded Earl (Bde1) gene promoter. Identical to 24320 except that the prZmBde1-02 that drives Cas9 expression was replaced with a shortened version prZmBde1-07. The sgRNA still targets the maize ADH1 gene. |
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |

-continued

| Position by bp | Component name | Description |
|---|---|---|
| 184-195 | xSTOPS-01 | 6-frame stop to minimize unintended ORF read-through |
| 231-3972 | prZmBde1-07 | A shortened version of the promoter of maize Bearded Ear1 gene (Zm00001d017614) from B73v5. Removed the first 300 bp of prZmBde1-02 and 1,696 bp of iZmBde1-01 from prZmBde1-02. |
| 2322-3957 | iZmBde1-02 | A shortened version of the first intron in the maize Bearded Ear1 gene (Zm00001d017614) from B73v5. Removed 1,696 bp from iZmBde1-01 (from 842 to 2,537). |
| 3979-8148 | cCas9-02 | Streptococcus pyogenes Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 8156-9307 | tZmBde1-01 | The terminator sequence of maize Bearded Ear1 gene (Zm00001d017614) from B73v5. |
| 9314-9688 | prOsU3-01 | Rice U3 promoter for pol III dependent transcription of non-coding RNAs |
| 9689-9794 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 9821-11813 | prUbi1-18 | prUbi1-10 (Ubiquitin promoter from Zea mays from Mycogen) with T to C at nt597, G to A at nt1047, C to T at nt1117 |
| 11826-13001 | cPMI-01 | E. coli manA gene encoding phosphomannose isomerase |
| 13040-14074 | tUbi1-04 | The terminator from the UBI1 gene from Zea mays, optimized to remove internal SbfI site |
| 14097-14108 | xSTOPS-01 | 6-frame stop to minimize unintended ORF read-through |
| 14109-14148 | xTAG-02 | 40 bp site for plant insert intactness testing and to stop readthrough ORFs. Typically by agro LB. |
| 14157-14286 | bNLB-05 | Left border region of T-DNA of Agrobacterium tumefaciens nopaline ti-plasmid. Differs from bNLB-03 by one base pair to remove ATG start codon for ORF pointing into flanking region. |
| 14566-15354 | cSpec-03 | Also called aadA; gene encoding the enzyme aminoglycoside 3'adenyltransferase that confers resistance to spectinomycin and streptomycin for maintenance of the vector in E. coli and Agrobacterium. aka cSPEC-03 |
| 15449-15579 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 15654-16379 | cVirG-01 | virG (putative) from pAD1289 with TTG start codon. virGN54D came from pAD1289 described in Hansen et al. 1994, PNAS 91: 7603-7607 |
| 16409-17482 | cRepA-03 | cRepA-01 (pVS1 replication protein) with A to G at nt735 |
| 17525-17929 | oVS1-02 | origin of replication and partitioning region from plasmid pVS1 of Pseudomonas (Itoh et al. 1984, Plasmid 11: 206-220); similar to GenBank Accession Number U10487; serves as origin of replication in Agrobacterium tumefaciens host |
| 18607-19413 | oCOLE-06 | The ColE1 origin of replication functional in E. coli derived from pUC19 25007: Binary vector for testing a shortened version of rice Apetala1 (AP1) gene promoter. Identical to 24460 except that the prOsAP1-01 that drives Cas9 expression was replaced with a shortened version prOsAP1-02. The sgRNA still targets the maize ADH1 gene. |
| 10-149 | bNRB-04 | Right border region of T-DNA of Agrobacterium tumefaciens nopaline ti-plasmid. Differs from bNRB-03 by 20 bp at 5' end. |
| 150-189 | xTAG-06 | 40 bp site for plant insert intactness testing and to stop readthrough ORFs. Typically by agro RB. 1 bp different than -01. |
| 190-201 | xSTOPS-01 | 6-frame stop to minimize unintended ORF read-through |
| 233-3440 | prOsAP1-02 | A shortened version of the promoter sequence of rice APETALA1 (AP1) gene (Os07t0108900-02) from japonica v3 genome. Removed 1,408 bp from the intron (iOsAP1-01) within prOsAP1-01. |
| 2418-3425 | iOsAP1-02 | A shortened version of the first intron of rice APETALA1 (AP1) gene (Os07t0108900-02) from japonica v3 genome. Removed 1,408 bp from iOsAP1-01 (498 to 1,905). |
| 3451-7620 | cCas9-02 | Streptococcus pyogenes Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 7631-8630 | tOsAP1-01 | Terminator sequence of rice APETALA1 (AP1) gene (Os07t0108900-02) from japonica v3 genome. |
| 8646-9020 | prOsU3-01 | Rice U3 promoter for pol III dependent transcription of non-coding RNAs |
| 9021-9126 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 9153-11145 | prUbi1-18 | prUbi1-10 (Ubiquitin promoter from Zea mays from Mycogen) with T to C at nt597, G to A at nt1047, C to T at nt1117 |
| 11158-12333 | cPMI-01 | E. coli manA gene encoding phosphomannose isomerase |
| 12372-13406 | tUbi1-04 | The terminator from the UBI1 gene from Zea mays, optimized to remove internal SbfI site |

| Position by bp | Component name | Description |
|---|---|---|
| 13429-13440 | xSTOPS-01 | 6-frame stop to minimize unintended ORF read-through |
| 13441-13480 | xTAG-02 | 40 bp site for plant insert intactness testing and to stop readthrough ORFs. Typically by agro LB. |
| 13489-13618 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 13898-14686 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 14781-14911 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 14986-15711 | cVirG-01 | virG (putative) from pAD1289 with TTG start codon. virGN54D came from pAD1289 described in Hansen et al. 1994, PNAS 91: 7603-7607 |
| 15741-16814 | cRepA-03 | cRepA-01 (pVS1 replication protein) with A to G at nt735 |
| 16857-17261 | oVS1-02 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |
| 17939-18745 | oCOLE-06 | The ColE1 origin of replication functional in *E. coli* derived from pUC19 25008: Binary vector for testing a shortened version of rice Apetala1 (AP1) gene promoter. Identical to 24460 except that the prOsAP1-01 that drives Cas9 expression was replaced with a shortened version prOsAP1-03. The sgRNA still targets the maize ADH1 gene. |
| 10-149 | bNRB-04 | Right border region of T-DNA of *Agrobacterium tumefaciens* nopaline ti-plasmid. Differs from bNRB-03 by 20 bp at 5' end. |
| 150-189 | xTAG-06 | 40 bp site for plant insert intactness testing and to stop readthrough ORFs. Typically by agro RB. 1 bp different than -01. |
| 190-201 | xSTOPS-01 | 6-frame stop to minimize unintended ORF read-through |
| 233-3814 | prOsAP1-03 | A shortened version of the promoter sequence of rice APETALA1 (AP1) gene (Os07t0108900-02) from japonica v3 genome. Removed 1,034 bp from prOsAP1-01 (717-1, 750). |
| 1384-3799 | iOsAP1-01 | First intron of rice APETALA1 (AP1) gene (Os07t0108900-02) from japonica v3 genome. |
| 3825-7994 | cCas9-02 | *Streptococcus pyogenes* Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 8005-9004 | tOsAP1-01 | Terminator sequence of rice APETALA1 (AP1) gene (Os07t0108900-02) from japonica v3 genome. |
| 9020-9394 | prOsU3-01 | Rice U3 promoterfor pol III dependent transcription of non-coding RNAs |
| 9395-9500 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 9527-11519 | prUbi1-18 | prUbi1-10 (Ubiquitin promoter from *Zea mays* from Mycogen) with T to C at nt597, G to A at nt1047, C to T at nt1117 |
| 11532-12707 | cPMI-01 | *E. coli* manA gene encoding phosphomannose isomerase |
| 12746-13780 | tUbi1-04 | The terminator from the UBI1 gene from *Zea mays*, optimized to remove internal SbfI site |
| 13803-13814 | xSTOPS-01 | 6-frame stop to minimize unintended ORF read-through |
| 13815-13854 | xTAG-02 | 40 bp site for plant insert intactness testing and to stop readthrough ORFs. Typically by agro LB. |
| 13863-13992 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 14272-15060 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 15155-15285 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 15360-16085 | cVirG-01 | virG (putative) from pAD1289 with TTG start codon. virGN54D came from pAD1289 described in Hansen et al. 1994, PNAS 91: 7603-7607 |
| 16115-17188 | cRepA-03 | cRepA-01 (pVS1 replication protein) with A to G at nt735 |
| 17231-17635 | oVS1-02 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |

| Position by bp | Component name | Description |
| --- | --- | --- |
| 18313-19119 | oCOLE-06 | The ColE1 origin of replication functional in *E. coli* derived from pUC19 |

25009: Binary vector for testing a shortened version of rice Apetala1 (AP1) gene promoter. Identical to 24460 except that the prOsAP1-01 that drives Cas9 expression was replaced with a shortened version prOsAP1-04. The sgRNA still targets the maize ADH1 gene.

| Position by bp | Component name | Description |
| --- | --- | --- |
| 10-149 | bNRB-04 | Right border region of T-DNA of *Agrobacterium tumefaciens* nopaline ti-plasmid. Differs from bNRB-03 by 20 bp at 5' end. |
| 150-189 | xTAG-06 | 40 bp site for plant insert intactness testing and to stop readthrough ORFs. Typically by agro RB. 1 bp different than -01. |
| 190-201 | xSTOPS-01 | 6-frame stop to minimize unintended ORF read-through |
| 233-2406 | prOsAP1-03 | A shortened version of the promoter sequence of rice APETALA1 (AP1) gene (Os07t0108900-02) from japonica v3 genome. Removed 1,034 bp from prOsAP1-01 (717-1, 750). |
| 1384-2391 | iOsAP1-01 | First intron of rice APETALA1 (AP1) gene (Os07t0108900-02) from japonica v3 genome. |
| 2417-6586 | cCas9-02 | *Streptococcus pyogenes* Cas9 (for CRISPR-associated) gene, which is part of an RNA-guided site-directed nuclease system. This is a mutated version of cCas9-01 with 1 silent point mutation (C to T in position 3381bp) to remove SanDI site. |
| 6597-7596 | tOsAP1-01 | Terminator sequence of rice APETALA1 (AP1) gene (Os07t0108900-02) from japonica v3 genome. |
| 7612-7986 | prOsU3-01 | Rice U3 promoterfor pol III dependent transcription of non-coding RNAs |
| 7987-8092 | rsgRNAZmADH1-01 | Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. |
| 8119-10111 | prUbi1-18 | prUbi1-10 (Ubiquitin promoter from *Zea mays* from Mycogen) with T to C at nt597, G to A at nt1047, C to T at nt1117 |
| 10124-11299 | cPMI-01 | *E. coli* manA gene encoding phosphomannose isomerase |
| 11338-12372 | tUbi1-04 | The terminator from the UBI1 gene from *Zea mays*, optimized to remove internal SbfI site |
| 12395-12406 | xSTOPS-01 | 6-frame stop to minimize unintended ORF read-through |
| 12407-12446 | xTAG-02 | 40 bp site for plant insert intactness testing and to stop readthrough ORFs. Typically by agro LB. |
| 12455-12584 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 12864-13652 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 13747-13877 | prVirG-01 | virG promoter (Winans J. Bact. 172: 2433-38 (1990)) composed of two promoter elements, one responsive to acetosyringone and phosphate-starvation (bp 45 to 83) and another to medium acidification (86 to 128) |
| 13952-14677 | cVirG-01 | virG (putative) from pAD1289 with TTG start codon. virGN54D came from pAD1289 described in Hansen et al. 1994, PNAS 91: 7603-7607 |
| 14707-15780 | cRepA-03 | cRepA-01 (pVS1 replication protein) with A to G at nt735 |
| 15823-16227 | oVS1-02 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |
| 16905-17711 | oCOLE-06 | The ColE1 origin of replication functional in *E. coli* derived from pUC19 |

Shortened promoters and introns are summarized below.

| SEQ ID NO: | Component | Description |
| --- | --- | --- |
| SEQ ID NO: 614 | modified prZmAP1 used in 24997 | A shortened version of the promoter of maize APETALA1 (AP1) gene (Zm00001d007949, GRMZM2G148693, Agamous-like MADS-box protein AGL8) from B73v5. Removed 1,746 bp from prZmAP1-01. |
| SEQ ID NO: 615 | modified prZmBde1 used in 25002 | A shortened version of the promoter of maize Bearded Ear1 gene (Zm00001d017614) from B73v5. Removed 1,746 bp from prZmBde1-02. Removed 1,696 bp from the intron (iZmBde1-01) within prZmBde1-02. |
| SEQ ID NO: 616 | modified prZmBde1 used in 25003 | A shortened version of the promoter of maize Bearded Ear1 gene (Zm00001d017614) from B73v5. Removed 1,746 bp from prZmBde1-02. Removed 2,337 bp from the intron (iZmBde1-01) within prZmBde1-02. |
| SEQ ID NO: 617 | modified prZmBde1 used in 25004 | A shortened version of the promoter of maize Bearded Ear1 gene (Zm00001d017614) from B73v5. Removed 1,746 bp from prZmBde1-02. Removed 2,291 bp from the intron (iZmBde1-01) within prZmBde1-02. |

-continued

| SEQ ID NO: | Component | Description |
|---|---|---|
| SEQ ID NO: 618 | modified prZmBde1 used in 25005 | A shortened version of the promoter of maize Bearded Ear1 gene (Zm00001d017614) from B73v5. The first 300 bp of prZmBde1-02 was removed. |
| SEQ ID NO: 619 | modified version of prZmBde1 used in 25006 | A shortened version of the promoter of maize Bearded Ear1 gene (Zm00001d017614) from B73v5. Removed the first 300 bp of prZmBde1-02 and 1,696 bp of iZmBde1-01 from prZmBde1-02. |
| SEQ ID NO: 620 | modified prOsAP1 used in 25007 | A shortened version of the promoter sequence of rice APETALA1 (AP1) gene (Os07t0108900-02) from japonica v3 genome. Removed 1,408 bp from the intron (iOsAP1-01) within prOsAP1-01. |
| SEQ ID NO: 621 | modified prOsAP1 used in 25008 | A shortened version of the promoter sequence of rice APETALA1 (AP1) gene (Os07t0108900-02) from japonica v3 genome. Removed 1,034 bp from prOsAP1-01 (717-1,750). |
| SEQ ID NO: 622 | modified prOsAP1 used in 25009 | A shortened version of the promoter sequence of rice APETALA1 (AP1) gene (Os07t0108900-02) from japonica v3 genome. Removed 1,034 bp from prOsAP1-01 (717-1,750) and 1,408 bp from iOsAP1-01 (498 to 1,905). |
| SEQ ID NO: 623 | modified intron in prZmAP1-03 | A shortened version of the intron in the maize APETALA1 (AP1) promoter (Zm00001d007949, GRMZM2G148693, Agamous-like MADS-box protein AGL8) from B73v5. Removed 1,746 bp from iZmAP1-01 (from 1,001 to 2,746). |
| SEQ ID NO: 624 | modified intron in prZmBde1-03 and prZmBde1-07 | A shortened version of the first intron in the maize Bearded Ear1 gene (Zm00001d017614) from B73v5. Removed 1,696 bp from iZmBde1-01 (from 3,233 to 4,928). |
| SEQ ID NO: 625 | modified intron in prZmBde1-04 | A shortened version of the first intron in the maize Bearded Ear1 gene (Zm00001d017614) from B73v5. Removed 1,696 bp from iZmBde1-01 (from 201 to 2,538). |
| SEQ ID NO: 626 | modified intron in prZmBde1-05 | A shortened version of the first intron in the maize Bearded Ear1 gene (Zm00001d017614) from B73v5. Removed 2,291 bp from iZmBde1-01 (from 842 to 3,132). |
| SEQ ID NO: 627 | modified intron in prOsAP1-02 and prOsAP1-04 | A shortened version of the first intron of rice APETALA1 (AP1) gene (Os07t0108900-02) from japonica v3 genome. Removed 1,408 bp from iOsAP1-01 (498 to 1,905). |

Example 6: Efficient Allele Replacement (Homology-Directed Repair) Via FMOS Promoter Driving Cas9

Embodiments of the invention may also be used for allele replacement, including improving the efficiency of allele replacement. Five constructs suitable for allele replacement are described below. All five designs utilize the same donor DNA and guide RNA sequences targeting the herbicide tolerance acetolactate synthase (ALS) gene GRMZM2G143008 on chromosome 5. The donor DNA contains approximately 1000 bp of sequence with high homology to the endogenous maize gene. Near the center of the donor sequence are a few SNPs that differ between the donor and the endogenous sequence, including one that induces amino acid 568 of the ALS coding sequence to change from a tryptophan to a leucine. This well-known mutation confers resistance to a broad spectrum of common herbicides. The use of the ALS target thus provides a dominant genetic signature of editing (allele replacement) success. Several events may be made for each of the six construct designs below, and T1 progeny and sprayed with the imazethapyr herbicide (312 ml/ha Pursuit). Those plants that survived the herbicide treatment are sampled, and the putative allele replacement alleles are amplified and sequenced.

The first design is to use an FMOS promoter to drive expression of the Cas9, to have the guideRNA driven from the rice U3 promoter, and to provide a copy of the DNA donor for homology-driven repair in the T-DNA vector. Alternatively, one can include guideRNA target sites flanking the DNA donor in the T-DNA, so that the donor may be liberated from the T-DNA insertion site and be available for use as a repair template for homology directed repair at the target site (e.g. in the ALS gene). For example vector construct 25123 (SEQ ID NO: 88).

The second, third, and fourth designs use two different FMOS promoters: one to drive the expression of the Cas9 (preferably, this promoter is active during pre-meiosis or meiosis in either or both of the male and female reproductive organs—the anthers and carpels); the other promoter is used to drive expression of a spliced mRNA that gives rise to trans-acting replication factors Rep and RepA from a Mastrevirus. In the example we use the wheat dwarf virus Rep/RepA coding sequence (see design below). The Rep/RepA initiates rolling circle amplification of the DNA donor, which sits between the long intergenic region (LIR) and short intergenic region (SIR) of that same virus, where the movement and coat protein genes would normally be. We put a ZsGreen sequence between the LIR and SIR where the Rep/RepA gene would normally be. The exact location of the ZcGreen and DNA donor may vary; their positions could be swapped for example.

The expression of the Rep/RepA could be driven by a constitutive promoter, but more typically it will be driven by an FMOS promoter. This may be useful because in some cases continuous induction of RepA expression is associated with a negative impact on overall plant fitness, health, and seed production. In many examples, the Rep/RepA is expressed during a very short window of time in the germinal cell lineage and then turns off just as the expression of Cas9, Cas12a or another targeted nuclease is turning on (through use of a second FMOS promoter). This design would constrain the expression of Rep/RepA to a short window of time (protecting against toxicity to the plant) but before the nuclease is expressed, to allow for sufficient time for the DNA donor to be amplified prior to the initiation of editing at the target gene. In many examples, the Rep/RepA is expressed about one or two days prior, or even just a few hours, prior to the editing nuclease (Cas9). In the design below, the early anther primordia-specific proven FMOS promoter prZmAGO18A, which has low or medium expression specifically in germinal cells of anthers and ovules, is used to drive the expression of the Rep/RepA gene. The expression of the Cas9 nuclease is controlled by the regulatory region of the prZmBde1-02 promoter, which is active during floral specification, pre-meiosis and meiosis. The construct also contains the DNA donor sequence which we want to be used in allele replacement, which includes homolog arms that share a high sequence similarity to the cut site in the native target locus, along with the LIR, ZsGreen, and SIR sequences in the same loop. The action of the RepA protein will lead to amplification by rolling circle amplification leading to an abundance of single stranded DNA donor molecules that may become double stranded by the activity of the host DNA polymerase. When double stranded, the loop could be cut by the Cas9 and guide RNA (see vector AR-SDN2_REP_NoCut (FIG. 33) (AR-SDN2_REP_NoCut (SEQ ID NO: 186). Optional one or more guide RNA target sites may also flank the donor sequence, as in the vector AR-SDN2_REP_2 Cuts (FIG. 32) (SEQ ID NO: #187) and vector AR-SDN2_REP_1cut (FIG. 31) (SEQ ID NO: 188)—these sites may be cut by the nuclease, linearizing and/or liberating the circular donor which may make it suitable to be available to participate in recombination (homology-directed repair) after target site cutting by the Cas9. The feature map for SEQ ID #XYZ (AR-SDN2_REP_CUT) is shown below. Further, in some embodiments, it will also be desirable to have the promoter driving RepA to be expressed at less than 50% of the promoter driving CRISPR. For example, in embodiments where phytotoxicity is observed or event production rates are desired to be increased, it may be desirable to reduce the expression of RepA.

In another example, the MSCA1 (MS22) promoter (prZmMSCA1-01) (SEQ ID NO: 717) (GRMZM2G442791) and terminator 1ZmMSCA1-01 (SEQ ID NO: 718) which drives expression during a very short window in flower development is used to express the Rep/RepA. This expression shuts off fairly quickly as this gene is responsible just for the specification of the germinal cells in anthers and ovules. A few hours later, the prZmAGO18A FMOS promoter turns on the expression of Cas9 in just-differentiated germinal cells in pre-meiotic staged anthers and ovules. In other designs, the FMOS promoter prOsMEL1 (SEQ ID NOs: 41 or 42) and terminators tOsMEL1 (SEQ ID NOs: 44 or 45) are used to drive the expression of the targeted nuclease. In another design, the highly expressed, putative FMOS promoters and terminators from the genes: proteophosphorglycan4 (ppg4) (GRMZM2G032528) having prZmPPG4-01 (SEQ ID NO: 719) and tZmPPG4-01 (SEQ ID NO: 720); NADH dehydrogenase (GRMZM2G158188) having promoter (SEQ ID NO: 721) and terminator (SEQ ID NO: 722); or CID11 (GRMZM2G173428) having promoter prZmCID11 (SEQ ID NO: 723) and terminator tZmCID11 (SEQ ID NO: 724) may be used to drive expression of the nuclease (highly expressed, very enriched germinal cell genes). In yet another design, a number of floral and germinal cell specific genes can be identified from this article source on the initial germinal cell population in flowers (Kelliher and Walbot (2014) Germinal Cell Initials Accommodate Hypoxia and Precociously Express Meiotic Genes *Plant Journal* 77(4) 639-652.), and from this source, two are selected: ideally, a low or medium expressed, highly specific gene, which can be used to drive the expression of the Rep/RepA, that is active slightly earlier in development than the second promoter, which is expressed at a much higher level and is used to express the nuclease.

FIG. 27 illustrates one embodiment including the use of one guide RNA target site flanking the donor sequence before the LIR and SIR. Sequential activation of RepA and Cas9 in flowers triggers high copy donor DNA available for use in allele replacement of a target site via homologous recombination. In this case, the target site is shown in the ALS target gene (GRMZM2G143008 on chromosome 5). This version has one gRNA cut site to linearize the amplified DNA donor replicon.

FIG. 28 illustrates another embodiment, which is similar to the embodiment of FIG. 27 but includes two guide RNA target sites in the replicon flanking the DNA donor sequence. This would, after cutting by Cas9 and guideRNA, completely liberate the amplified DNA donor from the LIR, ZsGreen, and SIR sequences.

FIG. 29 illustrates another embodiment, which is similar to the embodiment of FIG. 27, except no gRNA target sites flank the donor DNA, so that the amplified donor sequence remains circular, and is not linearized.

FIG. 30 illustrates another embodiment, which uses also uses two FMOS promoters, but in this case there are no viral elements. Instead, the first FMOS promoter (prAGO18a-01) drives expression of a reverse transcriptase (RT) enzyme that specifically interacts with a Retron RNA (e.g. Ec86) while the second FMOS promoter drives expression of the Cas9 or another targeted nuclease (SEQ ID AR-SDN2_RETRON). The donor DNA in this construct is produced in the cell via reverse transcription from a retron—donor RNA—guide RNA chimeric transcript which is under control of a rice U3 promoter. Reverse transcription of the retron sequence and donor RNA leads to covalent attachment of a donor DNA sequence to the guide RNA. This method of using a retron for allele replacement, which is also known as CRISPEY (Sharon, E., Chen, S-A. A., Khosla, N. M., Smith, J. D., Pritchard, J. K., and Fraser, H. B. (2018) FUNCTIONAL GENETIC VARIANTS REVEALED BY MASSIVELY PARALLEL PRECISE GENOME EDITING Cell 175(2): 544-557), delivers abundant donor DNA to the site of guideRNA and Cas9 double stranded break formation at the target site. In this example, we are using the FMOS promoters to increase the efficiency of allele replacement success over standard use of CRISPEY in embryos or the callus phase, which is presumed still quite inefficient and potentially phytotoxic. FIG. 44 illustrates schematic drawing of Vector AR-SDN2_RETRON (SEQ ID NO: 697), which is another retron based example according to various aspects of the disclosure.

FIG. 32, discussed above, showing a schematic drawing of Vector AR-SDN2_REP_2 Cuts (SEQ ID NO: 187) is one example of a vector suitable for allele replacement. Additional features of Vector AR-SDN2_REP_2 Cuts are further described in annotated below.

| Feature Name | Position | Description |
| --- | --- | --- |
| bNRB-04 | Start: 32 End: 171 (Complementary) | Right border region of T-DNA of *Agrobacterium tumefaciens* nopaline ti-plasmid. Differs from bNRB-03 by 20 bp at 5' end. |
| bNRB-01-01 | Start: 129 End: 153 (Complementary) | Left border region of T-DNA of *Agrobacterium tumefaciens* nopaline ti-plasmid. Differs from bNLB-03 by one base pair to remove ATG start codon for ORF pointing into flanking region. |
| xTAG-06 | Start: 172 End: 211 | 40 bp site for plant insert intactness testing and to stop readthrough ORFs. Typically by agro RB. 1 bp different than - 01. |
| xSTOPS-01 | Start: 212 End: 223 | 6-frame stop to minimize unintended ORF read-through |
| xLIR-03 | Start: 277 End: 685 (Complementary) | Long Intergenic Region (LIR, essential for DNA replication) derived from Wheat Dwarf Virus (WDV) without upstream or downstream 5'UTR sequences. |
| cZsGreen-07 | Start: 686 End: 1426 | This is the modified sequence of *Zoanthus* sp. green fluorescent protein, based on zGreen-03 which is faulty ZsGreen1 (3rd bp of stop codon missing) with additional 15 amino acids. The 720 T was mutated to C to interrupt Puvl restriction enzyme site for vector construction purpose, but the amino acid of Asp doesn't alter. |
| xSIR-02 | Start: 1427 End: 1598 (Complementary) | Short Intergenic Region (SIR) derived from Wheat Dwarf Virus (WDV) site between stop codons of RepA and Coat Protein. |
| xALS target-01 | Start: 1605 End: 1624 (Complementary) | Target site for the ALS guide RNA |
| xZmALS-02 | Start: 1625 End: 2463 (Complementary) | A 839 nt donor fragment to introduce the W574L mutation to maize ALS (for Acetolactate Synthase, GRMZM2G143008 on Chr5) gene conferring Imidazolinone tolerance through homologous recombination.. |
| xALS target-01 | Start: 2464 End: 2483 (Complementary) | Target site for the ALS guide RNA |
| xLIR-03 | Start: 2490 End: 2898 (Complementary) | Long Intergenic Region (LIR, essential for DNA replication) derived from Wheat Dwarf Virus (WDV) without upstream or downstream 5'UTR sequences. |
| prOsU3-01 | Start: 2899 End: 3273 | Rice U3 promoterfor pol III dependent transcription of non-coding RNAs |
| rsgRNAZmALS-01 | Start: 3274 End: 3389 | Single guide RNA (sgRNA) targeting maize ALS (for Acetolactate Synthase, GRMZM2G143008 on Chr5) gene in maize genome at sequence caagtatgtgtgcgctctgt. |
| ALS target | Start: 3275 End: 3294 | gRNA target site for cutting to liberate the donor or to edit the ALS gene target |
| rCrRNA-01 | Start: 3295 End: 3306 | A piece of crRNA (CRISPR RNA) from *Streptococcus pyogenes* CRISPR system, without target sequence, truncated at +12. It is used in conjunction with tracrRNA (trans-activating crRNA) to make the chimeric single guide RNA (sgRNA). |
| rTracrRNA-01 | Start: 3311 End: 3379 | A truncated form of tracrRNA (trans-activating crRNA) from *Streptococcus pyogenes* CRISPR system. It is used in conjunction with crRNA (CRISPR RNA) to make the chimeric sgRNA (single guide RNA). Contains poly T region from *Streptococcus pyogenes*, with one additional T added during synthesis. |
| prZmBde1-02 | Start: 3396 End: 9133 | The promoter of maize Bearded Ear1 gene (Zm00001d017614) from B73v5 for specific expression in early inflorescence meristems. The sequence includes upstream promoter, first exon, first intron, and second exon (partial), with two bp changes to remove ATG start codon and to remove one Bbsl site for cloning. Additionally, this version has an extended sequence at 5' end. |
| iZmBde1-01 | Start: 5787 End: 9118 | first intron of maize Bearded Ear1 gene (Zm00001d017614) from B73v5 |
| cCas9-02 | Start: 9140 End: 13309 | *Streptococcus pyogenes* Cas9 (for CRISPR-associated) gene, which is part of an RNA-guided site-directed nuclease system. This is a mutated version of cCas9-01 with 1 silent point mutation (C to T in position 3381 bp) to remove SanDl site. |
| xNLS-01 | Start: 13244 End: 13273 | A 10 amino acid long peptide identical to that of an unnamed protein from Oikopleura dioica, functioning as a nuclear locating signal. |
| xEpitope-01 | Start: 13274 End: 13300 | A 9 amino acid epitope tag identical to that of the GP64 envelope fusion protein (GP64 EFP) from baculovirus (Antheraea pernyi nucleopolyhedrovirus). |
| tZmBde1-01 | Start: 13317 End: 14468 | The terminator sequence of maize Bearded Ear1 gene (Zm00001d017614) from B73v5. |
| prZmAGO18A-01 | Start: 14475 End: 17430 | An FMOS promoter sequence |
| cRepA-09 | Start: 17437 End: 18578 | Replication and associated protein derived from Wheat dwarf virus which achieve DNA replication in cells. |
| iRepA | Start: 18067 End: 18152 | first intron of RepA gene |
| tZmAGO18A-01 | Start: 18590 End: 19869 | An FMOS terminator sequence of the maize; AGO18A-01 |

-continued

| Feature Name | Position | Description |
|---|---|---|
| prUbi1-18 | Start: 19896 End: 21888 | prUbi1-10 with T to C at nt597, G to A at nt1047, C to T at nt1117 |
| iUbi1-07 | Start: 20879 End: 21888 | iUbi1-02-01 with G to A at nt61 and C to T at nt134 |
| cPMI-01 | Start: 21901 End: 23076 | E. coli manA gene encoding phosphomannose isomerase |
| tUbi1-04 | Start: 23115 End: 24149 | The terminator from the UBI1 gene from Zea mays. optimized to remove internal Sbfl site |
| xSTOPS-01 | Start: 24172 End: 24183 | 6-frame stop to minimize unintended ORF read-through |
| xTAG-02 | Start: 24184 End: 24223 | 40 bp site for plant insert intactness testing and to stop readthrough ORFs. Typically by agro LB. |
| bNLB-05 | | Start: 24232 End: 24361 (Complementary) |
| bNLB-01-01 | Start: 24267 End: 24291 (Complementary) | 25 bp Left border repeat region of T-DNA of *Agrobacterium tumefaciens* nopaline ti-plasmid |
| cSpec-03 | Start: 24641 End: 25429 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| prVirG-01 | Start: 25524 End: 25654 | (Winans J. Bact. 172: 2433-38 (1990)) composed of two promoter elements, one responsive to acetosyringone and phosphate-starvation (bp 45 to 83) and another to medium acidification (86 to 128) |
| cVirG-01 | Start: 25729 End: 26454 | virG (putative) from pAD1289 with TTG start codon. virGN54D came from pAD1289 described in Hansen et al. 1994, PNAS 91: 7603-7607 |
| cRepA-03 | Start: 26484 End: 27557 | cRepA-01 with A to G at nt735 |
| oVS1-02 | Start: 27600 End: 28004 | origin of replication and partitioning region from plasmid pVS1 of Pseudomonas (Itoh et al. 1984, Plasmid 11: 206-220); similar to GenBank Accession Number U10487; serves as origin of replication in *Agrobacterium tumefaciens* host |
| oCOLE-06 | Start: 28682 End: 16 (Complementary) | The ColE1 origin of replication functional in *E. coli* derived from pUC19 |

Constructs are built to test different allele replacement designs using a Replicon containing the donor DNA, optionally flanked by guideRNA target sites, a Rep or RepA gene cassette controlled by one FMOS promoter, and a Cas9 or another nuclease cassette driven by another FMOS promoter, and a selectable marker cassette. Allele replacement frequency is determined in these preferred constructs as described by measuring the frequency of edits produced in the stably transformed plants (the T0 plants) and the number of successful allele replacements produced in the progeny (T1 plants). The guide RNA in these constructs targets exon 2 of ACETOLACTATE SYNTHASE (ALS, GRMZM2G143008) gene with a target site sequence of 5'-CAAGTATGTGTGCGCTCTGT-3' (SEQ ID NO: 6). The selectable marker is Phosphomannose Isomerase (PMI) under control of a constitutive promoter, and mannose selection is sed to recover stably transformed plants of the maize inbred line NP2222. For each construct, around 10 single-copy T0 events are identified and sent to maturity after seedling sampling confirms that there is no editing at the ADH1 target site. Expression of PMI and Cas9 is checked in leaves as well via qRT-PCR. Plants are outcrossed and self-pollinated.

Embryo rescue is performed followed by Taqman detection of allele replacement success, or mature seeds are planted and the germinated plants are sprayed with a standard concentration of herbicide such as Pursuit (e.g. imazethapyr) at a concentration of at least 200 mL/ha to determine the frequency of plant survival (as survival would likely be due to a successful allele replacement). Samples are taken and tested by Taqman assay to determine if the donor replaced the target sequence: if positive, this indicates a potentially successful replacement. Those survivors are sequenced to confirm that these truly represent clean SDN2-edited alleles.

As noted above, this allele replacement can be very challenging in plants, e.g. because the non-homologous end joining pathway is strongly favored for DNA repair. By using a FMOS promoter to drive the editing machinery, one may overcome the above-mentioned challenges and readily generate allele replacements in the majority of T0 events. Applicant's disclosure may be used to save significant time and significant resource costs. By using the instant technology, one can, in some examples, make five to ten events and recover the allele replacement in the T1 generation with relative ease compared to prior art. The improvement may be attributable, at least in part, to two factors. First, by generating a mosaic T0 plant with hundreds to thousands of edits, each T0 plant has a significantly better chance of producing at least one or more T1 seed with the allele swap. The diversity of mutations inherited in the seed reduces the effort and money required overall in the process—one can simply make a few events and screen the seed for the correct edit. Sequencing can then be used for screening as desired. It takes less time, money and labor to sequence 1000 T1 seed than it costs to produce 1000 T0 events. This is mostly because the sequencing is relatively fast and inexpensive. In short, FMOS regulatory systems, specifically FMOS promoters, provide a significant advantage. The second reason that FMOS promoters can increase the efficiency of the allele replacement is that the homologous recombination machinery can be expressed in the germinal lineage cells prior to and during meiosis. These factors that promote homologous repair are needed for the allele replacement, but they are not very highly expressed in the callus or vegetative tissues when the majority of the constitutive promoters will express Cas9 and make edits. For at least these reasons, applicant believes that FMOS promoters strongly outcompete constitutive promoters when it comes to allele replacement.

Exemplary Embodiments

1. A method for producing a plurality of unique allele replacements in a plant's T1 seed, the method comprising:
a) transforming at least one expression cassette into a plant cell or a plant tissue, wherein the at least one expression cassette comprises
a nucleic acid that encodes a DNA modification enzyme,
optionally, a nucleic acid that encodes at least one guide RNA (gRNA),
a nucleic acid of interest (Donor DNA),
a replication promoter operably linked to the Donor DNA to drive replication of the Donor DNA, and
a floral mosaic (FMOS) regulatory sequence, wherein the FMOS regulatory sequence
(i) mediates expression of the DNA modification enzyme in at least one of a floral primordia cell and a floral reproductive organ, and
(ii) mediates a plurality of unique allele replacements in the at least one of the floral primordia and the floral reproductive organ; and
b) regenerating the plant cell or plant tissue into a T0 plant having a plurality of T1 seed, wherein the T1 seed contain a plurality of unique allele replacements.
2. The method of 1, wherein the DNA modification enzyme is a site-directed nuclease selected from the group consisting of a meganuclease (MN), a zinc-finger nuclease (ZFN), a transcription-activator like effector nuclease (TALEN), a Cas9 nuclease, a Cpf1 nuclease, a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease.
3. The method of 1, wherein
the DNA modification enzyme is a Cas9 nuclease or a Cpf1 nuclease and
the at least one expression cassette comprises the nucleic acid that encodes a gRNA, wherein the nucleic acid that encodes a gRNA is operably linked to the FMOS promoter or a second promoter.
4. The method of any of the above, wherein the at least one expression cassette further comprises at least one LIR.
5. The method of any of the above, further comprising
growing the T1 seed to produce a plurality of T1 plants, and
measuring at least one phenotype in plants of the T1 generation, and
selecting a plant of the T1 generation based on the measuring of at least one phenotype, wherein the selected plant has an allele swap.
6. The method of 5, further comprising crossing the selected plant of the T1 generation having a unique edit with a plant not having the unique edit to produce a progeny having the unique edit.
7. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
8. The method of any of the above, wherein the FMOS regulatory sequence mediates more expression of the DNA modification enzyme in the floral primordia and the floral reproductive organ than in vegetative tissue, and wherein the FMOS regulatory sequence mediates more expression of the DNA modification enzyme in the floral primordia and the floral reproductive organ than in a seed (with relative amounts, e.g. at least 2× more, at least 3× more, being the same as described for other embodiments).
9. The method of any of the above, wherein the FMOS regulatory sequence comprises an FMOS promotor and an FMOS terminator.
10. The FMOS promoter may be selected from those described herein.
11. The FMOS terminator may be selected from those described herein.
12. The method of any of the above, wherein the plurality of unique allele replacements includes at least one of: at least 5, at least 10, at least 15, and at least 20, unique allele replacements.
13. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.
14. The method of any of the above, wherein FMOS regulatory sequence
(i) mediates expression of the DNA modification enzyme in both a male and a female floral reproductive organ, and
(ii) mediates a plurality of allele replacements in both a male and a female floral reproductive organ.
15. The method of any of the above, further comprising measuring the number of edits in at least one of the T0 flower, T0 tassel, and seed of the T0 plant.
16. At least one expression cassette as described in any of 1-15 above.
17. A plant produced by the method of 1-15.
18. A plant cell containing the at least one expression cassette of 16.

Example 7: Efficient Expression Alteration Via FMOS Promoter (Promoter Bashing)

Embodiments of the invention may also be useful to alter the expression of a gene. For example, an FMOS promoter driving an engineered nuclease may be partnered with multiple guide RNAs targeting the regulatory region of that gene (the promoter, terminator, 5' or 3' untranslated regions, introns, cis-enhancers or cis-repressors).

The construct thus contains the capacity to induce novel mutations in flowers at multiple locations in the regulatory region of the gene, creating small and large indels, and in some cases rearrangements, of that regulatory region. This can have many consequences on the way that the gene is regulated. In some germinal lineages and thus in some of the T1 progeny seed, this will lead to stable downregulation, stable upregulation, or an alteration of the tissue-specificity or performance of the gene in different genetic backgrounds. The idea of designing multiple guide RNAs to a gene's regulatory region is called promoter bashing, but significant improvements can be achieved with the use of an FMOS promoter. Thus, the combination of an FMOS promoter (or FMOS regulatory region) driving Cas9 with the promoter bashing concept is a major improvement over promoter bashing using a constitutive promoter. See Rodri'guez-Leal et al., 2017, Cell 171, 470-480, Oct. 5, 2017 for background information regarding promoter bashing.

Traditional promoter bashing concepts involve the generation of a large diversity of edits for a region. The instant disclosure improves promoter bashing by the use of the FMOS promoters to generate diversity much more efficiently and quickly and with minimal crossing effort.

To demonstrate efficient expression alteration via FMOS promoters, constructs were generated using the maize APETALA1 (ZmAP1) promoter to drive Cas12a activity, paired with multiple guide RNAs targeting regulatory sequences mediating expression of a transgene, encoding 5-enolpyruvylshikimate-3-phosphate (EPSP) synthase (EPSPS), which confers resistance to the herbicide glyphosate. In this event, regulatory sequence of the EPSPS gene comprise enhancer of Figwort mosaic virus (FMV) enhancer (eFMV), enhancer of Cauliflower mosaic virus 35S promoter (e35S), Maize ubi1 promoter (prZmUbi158), and Omega 5'UTR leader sequence of Tobacco Mosaic Virus (eTMV). The purpose of this experiment was to determine if editing some of the enhancer or promoter sequences using an FMOS promoter could generate a range of novel expression alleles of EPSPS. We identified a total number of eight guide RNAs designed to be paired with the nuclease Cas12a. These eight guide RNAs should have the capacity of generating unique edits on the regulatory sequences of the EPSPS transgene: two on the eFMV enhancer, two on the e35S enhancer, three on the prUbi158 promoter, and one on the eTMV translational enhancer. In the construct, expression of the guide RNAs were driven by constitutive Ubi4 promoter from sugarcane, with each guide RNA flanked by two self-cleavable ribozymes (Hammerhead and HDV) for efficient processing. Vectors also contain PMI as the selectable marker.

Construct 25068 (SEQ ID NO: 535) is a binary CRISPR construct targeting the EPSPS event in JHAX background to decrease expression level of the EPSPS trait gene. Expression of the endonuclease LbCas12a (previously referred to as LbCpf1) is driven by the maize Apetala1 promoter (prZmAP1-02) and terminator (tZmAP1-01) for specific expression in early and late male and female inflorescences. The crRNA cassette contains 8 multiplexed crRNAs driven by the sugarcane ubiquitin 4 promoter, prSoUbi4-02; targeting eFMV, e35S, prZmUbi158, and eTMV, with each crRNA flanked by two self-cleavable ribozymes (Hammerhead and HDV) for efficient guide RNA processing.

| Bp Position | Component Name | Construct 25068 Description |
|---|---|---|
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by *Agrobacterium* RB. 1 bp different than -01. |
| 184-195 | xSTOPS-01 | 6-frame stop to minimize unintended ORF read-through |
| 232-4003 | prZmAP1-02 | Promoter sequence of maize APETALA1 (AP1) gene (Zm00001d007949, GRMZM2G148693, Agamous-like MADS-box protein AGL8) from B73v5 for specific expression in early and late male and female inflorescences. The sequence includes the upstream promoter, first exon, first intron, and second exon (partial), with 2 bp changes to remove ATG Start codons. Differs from version 01 by an additional one bp change to remove an internal BsmBI site. |
| 4010-7792 | cLbCas12a-02 | Cas12a (previously referred to as Cpf1) is an RNA-guided endonuclease of a class II CRISPR/Cas system. CRISPR/Ca12a stands for Clustered Regularly Interspaced Short Palindromic Repeats from Prevotella and Francisella 1. This Cas12a is a rice codon-optimized version from Lachnospiraceae bacterium ND2006, based on Dr Qi's publication, except with 3 bp changes to remove 2 Bsp119I and one Rsrll sites. Two nuclear localization signals (NLS) are added at its N- and C-terminals respectively; N terminus also contains an epitope tag. |
| 7801-8800 | tZmAP1-01 | Terminator sequence of maize APETALA1 (AP1) gene (Zm00001d007949) from B73v5. |
| 8807-10608 | prSoUbi4-02 | The constitutive sugarcane ubi4 promoter. prScUbi4-01 with stop codons in all 3 ORFs and with an internal NcoI site removed. |
| 10616-10658 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 10659-10702 | rLbgRNACas12aFMV-01 | CRISPR/Cas12a (previously known as Cpf1) guide RNA including direct repeat of LbCrRNA targeting Figwort mosaic virus (FMV) at transcription enhancer regionGTAGGTGCGCCTAACAATTCTGC (eFMVTarget1). |
| 10703-10770 | rHDV-01 | A sequence encoding a self-cleavable ribozyme from hepatitis delta virus (HDV). |
| 10780-10822 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 10823-10866 | rLbgRNACas12a35S-01 | CRISPR/Cas12a (previously known as Cpf1) guide RNA including direct repeat of LbCrRNA targeting Cauliflower mosaic virus 35S enhancer at transcription enhancer regionTTGTGAAGATAGTGGAAAAGGAA (e35STarget1). |
| 10867-10934 | rHDV-01 | A sequence encoding a self-cleavable ribozyme from hepatitis delta virus (HDV). |

| Bp Position | Component Name | Construct 25068 Description |
|---|---|---|
| 10941-10983 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 10984-11027 | rLbgRNACas12aZmUbi158-01 | CRISPR/Cas12a (previously known as Cpf1) guide RNA including direct repeat of LbCrRNA targeting maizeUbiquitin2 gene (GRMZM2G419891, Zm00001d053838) at promoter region CTCTATCTTCTCTCCGCCTGCTC (prZmUbi158Target1). |
| 11028-11095 | rHDV-01 | A sequence encoding a self-cleavable ribozyme from hepatitis delta virus (HDV). |
| 11104-11146 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 11147-11190 | rLbgRNACas12aTMV-01 | CRISPR/Cas12a (previously known as Cpf1) guide RNA including direct repeat of LbCrRNA targeting translationalenhancer from the TMV omega sequence atTGTAAATAGTAATTGTAATGTTG (eTMVTarget1). |
| 11191-11258 | rHDV-01 | A sequence encoding a self-cleavable ribozyme from hepatitis delta virus (HDV). |
| 11268-11310 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 11311-11354 | rLbgRNACas12aFMV-02 | CRISPR/Cas12a (previously known as Cpf1) guide RNA including direct repeat of LbCrRNA targeting Figwort mosaicvirus (FMV) at transcription enhancer regionACGAACGCAGTGACGACCACAAA (eFMVTarget2). |
| 11355-11422 | rHDV-01 | A sequence encoding a self-cleavable ribozyme from hepatitis delta virus (HDV). |
| 11434-11476 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 11477-11520 | rLbgRNACas12a35S-02 | CRISPR/Cas12a (previously known as Cpf1) guide RNA including direct repeat of LbCrRNA targeting Cauliflowermosaic virus 35S enhancer at transcription enhancer regionCACGATGCTCCTCGTGGGTGGGG (e35STarget2). |
| 11521-11588 | rHDV-01 | A sequence encoding a self-cleavable ribozyme from hepatitis delta virus (HDV). |
| 11597-11639 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 11640-11683 | rLbgRNACas12aZmUbi158-03 | CRISPR/Cas12a (previously known as Cpf1) guide RNA including direct repeat of LbCrRNA targeting maizeUbiquitin2 gene (GRMZM2G419891, Zm00001d053838) at promoter region TTAGAATATATAGGTACTCAAGA (prZmUbi158Target3). |
| 11684-11751 | rHDV-01 | A sequence encoding a self-cleavable ribozyme from hepatitis delta virus (HDV). |
| 11761-11803 | rHHLbCrRNA-01 | Hammerhead RNA; a conserved sequence motif from Satellite RNAs of certain viruses, including Tobacco ringspot virus, responsible for self-cleavage. Pairing sequence was added at 5' end to ensure proper cleavage. |
| 11804-11847 | rLbgRNACas12aZmUbi158-02 | CRISPR/Cas12a (previously known as Cpf1) guide RNA including direct repeat of LbCrRNA targeting maizeUbiquitin2 gene (GRMZM2G419891, Zm00001d053838) at promoterregion ATAATTCTTGAGTTGATTTTTAC (prZmUbi158Target2). |
| 11848-11915 | rHDV-01 | A sequence encoding a self-cleavable ribozyme from hepatitis delta virus (HDV). |
| 11916-12168 | tNOS-05-01 | synthetic Nopaline synthetase terminator |
| 12176-14168 | prUbi1-18 | prUbi1-10 with T to C at nt597, G to A at nt1047, C to T at nt1117 |
| 14176-15351 | cPMI-14 | Synthetic phosphomannose isomerase gene with maize-modified codons. PMI-12 with 5 nucleotide changes (silent) to remove internal cloning sites useful for Beijing and RTP sites: C96A (NcoI), C129A (SacI), C354A (NcoI), C759T (BsaI), C999T (BsaI). |
| 15364-16398 | tUbi1-06 | The terminator from the UBI1 gene from *Zea mays*. Optimized version of tUbi1-01 to remove internal SbfI (C243G) and BsmBI (C502G) sites. |
| 16421-16432 | xSTOPS-01 | 6-frame stop to minimize unintended ORF read-through |
| 16433-16472 | xTAG-02 | 40 bp site for plant insert intactness testing and to stop readthrough ORFs. Typically by agro LB. |
| 16481-16610 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 16890-17678 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |

| Bp Position | Component Name | Construct 25068 Description |
|---|---|---|
| 17773-17903 | prVirG-02 | virG promoter composed of two promoter elements, one responsive to acetosyringone and phosphate-starvation (bp 45 to 83) and another to medium acidification (86 to 128). Removed BstXI site (C to G) compared with prVirG-01.; 30 |
| 17978-18703 | cVirG-06 | Modified cVirG. Differs from cVirG-01 by single bp (base 255) change: a silent mutation to eliminate internal BsmBI site. |
| 18733-19806 | cRepA-05 | Modified cRepA. Differs from cRepA-01 by base 78 and 390 change: silent mutations to eliminate internal two SfiI sites. |
| 19849-20253 | oVS1-03 | Modified oVS1. Differs from oVS1-02 by base 15 and 243 change: two mutations to eliminate internal BsaI and BspQI sites. |
| 20931-21737 | oCOLE-06 | The ColE1 origin of replication functional in *E. coli* derived from pUC19 |

We transformed the NP2222 plants homozygous for the event transgene with construct 25068 and following standard protocol, through *Agrobacterium* mediated transformation of immature embryos. Several events were sent to the greenhouse, grown to maturity, and backcrossed to 'wild-type' plants to generate BC1 (back-cross1) generation seed. A diverse set of mutations were recovered in BC1 seedlings obtained through embryo rescue or planting. DNA extraction and analysis was performed using target-specific Taqman assays that were designed to detect editing in five of the targets (see Table 27 for details). Three unique editing patterns were identified among seedlings from the backcrossed ear of the event UR228452062 (also called GVG01191245) carrying construct 25068 We isolated 100 embryos, but several did not germinate and so we only ended up testing the Taqman assays on 30 plants. Of those 30 plants, plant numbers 3, 78, and 92 each contained a single mutation. Plant 3 contained a 2 bp deletion in the 35S enhancer site. Plant 78 contained an 8 bp deletion in the FMV target site 1. Plant 92 contained a 5 bp deletion in the FMV target site 1. These plants all had a single copy of the FMOS editing cassette and had different edits recovered among the progenies of this backcrossed event.

TABLE 27

| Plant ID (BC1) | Taqman Backbone | Taqman Cas12a | Raw Taqman read FMV Target 1 | Taqman Score FMV Target 1 | Raw Taqman read 35S Target 2 | Taqman Score 35S Target 2 | Sequencing variant detected |
|---|---|---|---|---|---|---|---|
| BC-1 UR228452062-3 | 0 | 1 | 0.86 | 1 | 0.18 | 0 | 35S Target 2 2 bp deletion |
| BC-1 UR228452062-78 | 0 | 1 | 0.68 | 1 | 0.65 | 1 | FMV target 1 8 bp deletion |
| BC-1 UR228452062-92 | 0 | 1 | 0.00 | 0 | 0.85 | 1 | FMV target 1 5 bp deletion |

There were many other edited alleles created this way and recovered in the BC1. Thus, we have created a diverse set of alleles for the promoter of the EPSPS gene. The plants containing these alleles were sent to the greenhouse and grown to maturity and self-pollinated. In the BC1-(selfed) generation, homozygous plants carrying these three new expression alleles are to be grown alongside the wildtype and original EPSPS event and may be evaluated for expression changes that result from the diverse set of edits among the different events by qRT-PCR. The lines with lowered expression may then be then examined further (for instance, using agronomic assays and herbicide applications to examine the tolerance level and agronomic performance of those plants as compared with the original construct).

Exemplary Embodiments

1. A method for altering a target gene's expression in a plant's T1 seed, the method comprising:
   a) transforming at least one expression cassette into a plant cell or a plant tissue, wherein the at least one expression cassette comprises
      a nucleic acid that encodes a DNA modification enzyme,
      a nucleic acid that encodes at least one guide RNA (gRNA), wherein the at least one guide RNA targets a regulatory region of the target gene, and
      a floral mosaic (FMOS) regulatory sequence, wherein the FMOS regulatory sequence
         (i) mediates expression of the DNA modification enzyme in at least one of a floral primordia cell and a floral reproductive organ, and
         (ii) mediates a plurality of edits in the regulatory region of the target gene in at least one of the floral primordia and the floral reproductive organ; and
   b) regenerating the plant cell or plant tissue into a T0 plant having a plurality of T1 seed, wherein the T1 seed contain a plurality of unique edits in the regulatory region of the target gene, thereby creating a plurality of target gene expression profiles.

2. The method of 1, wherein the plurality of unique edits are selected from the group consisting of a plurality of unique a plurality of unique base insertions, and a plurality of unique base deletions.

3. The method of any of the above, wherein the DNA modification enzyme is a site-directed nuclease selected from the group consisting of a Cas9 nuclease, a Cpf1 nuclease, a dCas9-FokI, a dCpf1-FokI, a chimeric Cas9-cytidine deaminase, a chimeric Cas9-adenine deaminase, a chimeric FEN1-FokI, and a MegaTALs, a nickase Cas9 (nCas9), a chimeric dCas9 non-FokI nuclease and a dCpf1 non-FokI nuclease.

4. The method of any of the above, wherein the DNA modification enzyme is a Cas9 nuclease or a Cpf1 nuclease.
5. The method of any of the above, wherein the regulatory region of the target gene to be targeted includes at least one of a promoter, a terminator, a 5' or 3' untranslated region, an introns, a cis-enhancer and a cis-repressor.
6. The method of any of the above, further comprising growing the T1 seed to produce a plurality of T1 plants, and
measuring at least one phenotype in plants of the T1 generation, and
selecting a plant of the T1 generation based on the measuring of at least one phenotype, wherein the selected plant has a unique edits in the regulatory region of the target gene.
7. The method of 6, further comprising crossing the selected plant of the T1 generation having a unique edit with a plant not having the unique edit to produce a progeny having the unique edit.
8. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
9. The method of any of the above, wherein the FMOS regulatory sequence comprises an FMOS promotor and an FMOS terminator.
10. The FMOS promoter and terminator may be any of those disclosed herein.
11. The method of 1, wherein the plurality of unique edits includes at least one of: at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique edits.
12. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.
13. The method of any of the above, wherein FMOS regulatory sequence
(i) mediates expression of the DNA modification enzyme in both a male and a female floral reproductive organ, and
(ii) mediates a plurality of edits in both a male and a female floral reproductive organ.
14. The method of any of the above, wherein the FMOS regulatory sequence mediates more expression of the DNA modification enzyme in the floral primordia and the floral reproductive organ than in vegetative tissue, and wherein the FMOS regulatory sequence mediates more expression of the DNA modification enzyme in the floral primordia and the floral reproductive organ than in a seed (with relative amounts, e.g. at least 2× more, at least 3× more, being the same as described for other embodiments).
15. The method of any of the above, wherein the T0 plant has a mosaicism score of at least 0.5, 1, 1.5, 2, 3, 4, 5, 6, 7, 8, 9, 10, 11, 12, 13, 14, 15, 16 17, 18, 19, and 20, wherein the mosaicism score is determined by Mosaicism Score Methodology 1. The upper limit of the mosaicism score will be determined by the efficacy of the FMOS promoter, however, applicant expects typical mosaicism scores to be in the range of at least one of 0.5 to 30, 1 to 25, 2 to 25, 3 to 25, 4 to 25, 5 to 25, 6 to 25, 5 to 20, 5 to 19, 5 to 18, 5 to 17, 5 to 16, and 5 to 15.
16. At least one expression cassette including any combination of the components described in 1-14 above.
17. A plant produced by the method of 1-14, wherein the plant has an altered phenotype.
18. A plant cell containing at least one expression cassette of 15.

Example 8: *Arabidopsis* Promoters

Embodiments of the invention may also be used in *Arabidopsis*. For example, one may look for highly expressed/putative meiocyte-specific *Arabidopsis* genes with homologs in soy and tomato that had similar expression patterns (typically just flower or FM expression for these species). Ideal examples would include genes that were highly expressed in meiocytes and anthers, but low/off in seedling and shoot apical meristem (SAM). One may also check for expression in megaspore mother cells. Highly expressed or meiocyte-specific *Arabidopsis* genes way be identified by mining the normalized expression data from Dukowic-Schulze, Anthony Harris, Junhua Li, Anitha Sundararajan, Joann Mudge, Ernest F. Retzel, Wojciech P. Pawlowski, Changbin Chen (2014) COMPARATIVE TRANSCRIPTOMICS OF EARLY MEIOSIS IN *ARABIDOPSIS* AND MAIZE *JOURNAL OF GENETICS AND GENOMICS* 41(3): 139-152. Replicate data may be averaged and quantiles calculated using the averaged data for all genes (19,509 genes). Of those genes, for example, the 79 genes which expressed >90% quantile in meiocytes AND <10% quantile in seedling would represent putative FMOS promoter sources. Putative soy and tomato orthologs may be identified using PANTHER (pantherdb.org/genest. SAM expression may be obtained using data from Anna V. Klepikova, Artem S. Kasianov, Evgeny S. Gerasimov, Maria D. Logacheva, Aleksey A. Penin (2016) A HIGH RESOLUTION MAP OF THE *ARABIDOPSIS THALIANA* DEVELOPMENTAL TRANSCRIPTOME BASED ON RNA-SEQ PROFILING *THE PLANT JOURNAL* 88(6): 1058-1070 accessed through //travadb.org/; Relative expression levels may be inferred based on reported values. Megaspore mother cell (MMC) presence/absence may be obtained using data in Table S1—microarray data with given presence/absence calls in each of the 4 MMC replicates was obtained from: Anja Schmidt, Samuel E. Wuest, Kitty Vijverberg, Celia Baroux, Daniela Kleen, Ueli Grossniklaus (2011) TRANSCRIPTOME ANALYSIS OF THE *ARABIDOPSIS* MEGASPORE MOTHER CELL UNCOVERS THE IMPORTANCE OF RNA HELICASES FOR THE PLANT GERMLINE DEVELOPMENT PLoS BIOLOGY 9(9):e1001155. Another public data source used to verify expression of the *Arabidopsis* genes is the website: //travadb.org/browse/BaySeq/AT5G40260/RawNorm/AvNorm/Color=RCount.

Candidate FMOS promoters may be evaluated in *Arabidopsis* in very much the same way as described above for maize: promoters are identified by virtue of the expression pattern (enriched in flower parts while off or less expressed in meristem and seed) of the genes' they control. These promoters are then used to drive editing machinery in a binary vector which is transformed into *Arabidopsis*, for instance by floral dip transformation using *Agrobacterium* (see construct 25231 which uses the promoter and terminator of the germinal cell specific gene MALE MEIOCYTE DEATH1 [MMD1]). The transformed plants are grown to maturity and allowed to self-pollinate, and then the diversity of mutations in progeny seeds are evaluated. The target gene GLABROUS1 may be selected due to the ease of visual scoring of trichomeless plants, which is the phenotype associated with a knockout of both copies of the gene (homozygous edited); trichome free plants are then evaluated by PCR-sequencing as a method of discovering whether a given promoter tested was the best at creating a large diversity of mutations in the subsequent progeny after the FMOS activity takes place in the transformed flowers. As previously stated for maize, some embodiments include not only the promoter, but also the terminator, and optionally the first intron and exon and the first 15 bp of the second exon, the exons for which will typically be modified to make them non-translatable. The constructs also may contain a kanamycin resistance cassette or another selectable marker and also a U3 promoter driving one or more guide RNAs (e.g. 5'-ggaaaagttgtagactgaga-3' (SEQ ID NO: 714) or 5'-atggactatgttcttaatca-3' (SEQ ID NO: 715) targeting the GLABROUS1 gene's coding sequence or any other target in the genome. Transformed progeny may be selected on Kanamycin media. Events may be identified that are stably transformed and have one or more copies of the prFMOS:Cas9 or prFMOS:Cas12a or other transgene but have still 2 copies of the GLABROUS1 wild type allele by Taqman assay and that have trichomes by visual inspection (glabrous mutant plants do not have trichomes on their leaves). The percentage of transformed plants for the three promoters that were not edited may be greater than 30%, greater than 50%, or greater than 90%. These plants may be allowed to self-pollinate, and individual siliques are harvested and then tracked during germination of subsequent progeny seed in pots. The number of glabrous individuals per pot (and thus per silique) may be recorded and then sequenced to determine the mutations at the guide RNA target sites. Or the DNA from the whole batch of plants or seeds from a given silique (which derives from one flower) are combined and subjected to NGS, and the mosaicism score is then calculated by tracking the position of those flowers on a plant map. Promoters giving high frequency glabrous progeny and a very high diversity of mutations, will have high mosaicism scores which would show that these promoters are very high quality meiotic-staged FMOS promoters for dicots.

These same promoters may have homologs in soybean, tomato, sunflower, and other dicots which can be used according to various embodiments of the invention. Further, in some examples, *Arabidopsis* promoters (regulatory regions) themselves would have great FMOS activity if they were transformed into those crops or if those homologous genes' promoters were used. In many dicots, these promoters and their homologs may be interchangeable.

Examples of other high quality FMOS promoters in *Arabidopsis* can include prAtAPETALA1 (AT3G02310), prAtSEPELLATA2 (AT3G54340), prAtMALEMEIOCYTEDEATH1 (prAtMMD1) (AT1G66170) and also the promoters from the sunflower, tomato, tobacco, or soybean orthologues of those genes. Additional examples are included in Table 28. These promoters were specifically identified as high quality potential FMOS candidates because of their high and specific expression in meiotic cells, and in anthers, ovules or flowers, and their low expression in the shoot apical meristem (SAM) and seedling tissues. If one is able to discern from the expression studies of a particular gene that the gene is expressed in the germinal cells at a high level, and at a relatively low level in precursor callus, embryo, seed, seedling, or shoot apical meristem cells, that gene's regulatory regions may make good candidate to use for testing for FMOS activity—in particular if one can establish that the promoter drives expression highly in germinal cells of either or both male and female tissues of the flower.

Table 28 shows *Arabidopsis* genes highly expressed in meiotic cells and anthers but low or off in seed, and shoot apical meristem. These regulatory regions of genes, as well as their tomato and soybean orthologs, make be employed in some embodiments of the invention.

TABLE 28

| Gene | Description | Avg Meiocyte | Seedling | Anther | SAM | Tomato Ortholog | Soy Ortholog |
| --- | --- | --- | --- | --- | --- | --- | --- |
| AT4G16270 | peroxidase superfamily protein | 96484 | 30 | 29933 | Off | Solyc01g058520.2.1 | Glyma.07G237400.1 |
| AT1G27710 | Glycine-rich protein family | 83821 | 11.6 | 29677 | Off | NA | NA |
| AT3G52130 | lipid-transfer protein | 75979 | 9.28 | 12101 | Off | NA | Glyma.15G271600.1 & Glyma.08G152200.1 |
| AT5G52160 | lipid-transfer protein | 54292 | 0.6 | 19931 | Off | Solyc01g009590.2.1 | Glyma.09G144000.1 |
| AT4G14080 | MATERNAL EFFECT EMBRYO ARREST 48 | 48801 | 1.25 | 12179 | Off | Solyc12g098560.1.1 | Glyma.13G173200.1 |
| AT5G62080 | lipid-transfer protein | 36988 | 1.3 | 13551 | Off | NA | NA |
| AT1G33430 | KAONASHI 4; UNEVEN PATTERN OF EXINE1; | 30102 | 27.27 | 14687 | Off | Solyc11g042810.1.1 | Glyma.09G233700 & Glyma.12G003100 |
| AT5G44540 | Tapetum specific protein TAP35/TAP44 | 26184.662 | 4.98857 | 8397.1 | Off | NA | NA |
| AT4G29980 | fasciclin-like arabinogalactan | 14025 | 1.8447 | 4093.4 | Off | NA | NA |

TABLE 28-continued

| Gene | Description | Avg Meiocyte | Seedling | Anther | SAM | Tomato Ortholog | Soy Ortholog |
|---|---|---|---|---|---|---|---|
| AT1G61070 | LOW-MOLECULAR-WEIGHT CYSTEINE-RICH | 11707.389 | 0.64958 | 3574.4 | Off | NA | NA |
| AT5G15720 | GDSL-MOTIF LIPASE 7 --- | 9710.848 | 6.07965 | 3776.7 | Off | NA | NA |
| AT5G20240 | PISTILLATA | 9514.411 | 13.7186 | 7888.7 | Off | Solyc06g059970.2.1 | Glyma.14G155100.1 |
| AT5G07230 | lipid-transfer protein | 9128.066 | 0.64958 | 3083.8 | Off | NA | NA |
| AT5G24820 | Eukaryotic aspartyl protease | 8510.277 | 3.14387 | 3049.9 | Off | NA | NA |
| AT1G75790 | SKU5 SIMILAR 18 | 8038.433 | 3.63738 | 3779.5 | Off | Solyc04g081520.1.1 | NA |
| AT3G07450 | lipid-transfer protein | 7266.361 | 0.59756 | 2322.1 | Off | Solyc01g086830.2.1 | Glyma.15G271600.1 |
| AT5G41890 | GDSL-motif esterase/ | 6837.139 | 12.6795 | 2916.7 | Off | Solyc08g008620.2.1 | NA |
| AT4G34850 | LESS ADHESIVE POLLEN 5, PKSB, | 6171.75 | 11.5097 | 4076.5 | Off | Solyc01g111070.2.1 | Glyma.11G097900.1 |
| AT5G53190 | SWEET3; Nodulin MtN3 | 5908.217 | 0.59756 | 1663.8 | Off | Solyc03g007360.2.1 | Glyma.14G160100.1 |
| AT3G17675 | Blue copper-binding | 5503.323 | 1.19512 | 2000.9 | Off | Solyc08g079780.1.1 | Glyma.09G166200.1 |
| AT1G67481 | MIR839a | 5469.883 | 0.59756 | 1194.9 | Off | NA | NA |
| AT1G73050 | (R)-mandelonitrile lyase-like | 5167.038 | 4.39101 | 1246.1 | Off | Solyc03g123820.1.1 | Glyma.07G003300.1 |
| AT5G15140 | Aldose 1-epimerase family protein | 5058.443 | 3.09185 | 1521.3 | Off | NA | Glyma.09G239800.1 |
| AT5G22430 | Pollen Ole e 1 allergen and extensin family | 4934.231 | 8.57393 | 6260.6 | Off | NA | NA |
| AT3G02310 | SEPALLATA2 | 4883.843 | 3.68941 | 4889.8 | Off | Solyc02g089200.2.1 | Glyma.08G250700 & [[and]] others |
| AT3G54340 | Floral homeotic protein APETALA 3 | 4458.293 | 1.89673 | 5068 | Off | Solyc04g081000.2.1 | Glyma.04G027200 |
| AT5G40260 | SWEET8; Nodulin MtN3 | 4115.754 | 0 | 1548.9 | Off | NA | NA |
| AT1G69500 | Cytochrome P450 704B1 | 3742.877 | 1.8447 | 2516.7 | Off | Solyc01g010900.2.1 | Glyma.07G043300.1 |
| AT5G40940 | Putative fasciclin- | 3676.315 | 1.24714 | 710.21 | Off | Solyc05g008320.1.1 | Glyma.10G265700.1 |
| AT5G25950 | Protein of Unknown Function (DUF239) | 3506.181 | 9.8731 | 1545.6 | Off | Solyc11g070080.1.1 & Solyc11g070090.1.1 | Glyma.17G231500.1 & Glyma.06G050400.1 |
| AT3G59510 | Leucine-rich repeat (LRR) family protein | 3245.773 | 11.0162 | 1474.9 | Off | Solyc05g050700.1.1 | Glyma.15G029600.1 |
| AT5G51480 | Monocopper oxidase-like SKS2 | 3070.832 | 3.79345 | 1111.9 | Off | NA | NA |
| AT2G16210 | Transcriptional factor B3 family | 3009.958 | 4.39101 | 5157.7 | Off | NA | NA |
| AT1G74870 | RING/U-box superfamily protein | 2925.123 | 21.695 | 611.05 | Off | NA | NA |
| AT1G73890 | lipid-transfer protein | 16955.915 | 78.466 | 8946.2 | Very Low/Off | Solyc03g119620.1.1 | Glyma.07G090600.1 |
| AT3G28500 | 60S acidic ribosomal protein | 14645.556 | 17.9015 | 7932.9 | Very Low/Off | NA | NA |
| AT5G26730 | Fasciclin-like arabinogalactan | 13405.191 | 22.1885 | 5382.9 | Very Low/Off | NA | Glyma.14G007200.1 & Glyma.02G305800.1 |
| AT4G10850 | SWEET7; Nodulin MtN3 | 4384.026 | 4.78048 | 2072.3 | Very Low/Off | Solyc12g055870.1.1 & Solyc08g082770.2.1 | Glyma.20G066500.1 |
| AT2G27035 | EARLY NODULIN-LIKE PROTEIN 20 -- | 10346.838 | 19.3567 | 4750.8 | Very Low | Solyc02g088380.1.1 | Glyma.20G053100.1 |
| AT1G79780 | CASP-like protein 3A2 - | 2986.781 | 33.8022 | 889.11 | Very Low | Solyc03g120870.2.1 | Glyma.07G017000.1 |

TABLE 28-continued

| Gene | Description | Avg Meiocyte | Seedling | Anther | SAM | Tomato Ortholog | Soy Ortholog |
| --- | --- | --- | --- | --- | --- | --- | --- |
| AT4G21590 | Endonuclease 3 -- | 5339.133 | 49.6256 | 4264 | Low-Very Low | Solyc02g078920.2.1 | Glyma.07G191100 & Glyma.08G058100 |
| AT4G33870 | Putative Peroxidase 48 | 5266.362 | 3.09185 | 1039.1 | Low-Very Low | Solyc03g120800.2.1 | Glyma.15G259500.1 |
| AT1G72260 | Thionin-2.1 | 4605.75 | 14.4455 | 3458.3 | Low-Very Low | NA | NA |
| AT5G06820 | Protein STRUBBELIG | 4083.692 | 22.9941 | 768.52 | Low-Very Low | Solyc03g059020.1.1 | Glyma.10G091400.1 |
| AT1G24260 | SEP3; K-box region and MADS-box in | TOO highly expressed everywhere 3839.732 | 30.3209 | 3863.8 | Low-Very Low | Solyc05g015750.2.1 | lots |
| AT1G53160 | Squamosa | 3481.928 | 130.898 | 4450 | Low-Very Low | Solyc07g062980.2.1 | Glyma.06G238100 & Glyma.12G226000.1 & Glyma.13G274900.1 |
| AT4G10950 | SGNH hydrolase-type esterase | 3247.862 | 6.23572 | 457.01 | Low-Very Low | Solyc08g082490.1.1 | Glyma.01G226300.1 |
| AT5G38820 | Transmembrane amino acid transporter | 3241.379 | 50.5873 | 986.02 | Low-Very Low | NA | Glyma.08G254200.1 and others |
| AT2G36660 | POLY(A) BINDING PROTEIN 7 - | 7423.35 | 21.5389 | 1893.5 | Low | Solyc10g085750.1.1 & Solyc09g008620.1.1 | Glyma.19G188700.1 |
| AT5G47600 | HSP20-like chaperones | 6809.543 | 9.76905 | 5858.3 | Low | NA | NA |
| AT1G75030 | THAUMATIN-LIKE PROTEIN 3: meiocyte specific! | 6003.067 | 114.143 | 1696.9 | Low | Solyc04g079890.2.1 | Glyma.14G077400 & Glyma.14G077300 & Glyma.17G248300 |
| AT1G77410 | BETA-GALACTOSIDASE 16 | 5918.439 | 133.6 | 2451.7 | Low | Solyc11g018490.1.1 | Glyma.06G115400.1 |
| AT2G31220 | Transcription factor bHLH10 | 5617.677 | 22.1364 | 6393.2 | Low | NA | Glyma.08G089100 & Glyma.05G134400 |
| AT1G15190 | Fasciclin-like arabinogalactan | 5442.16 | 25.1763 | 890.62 | Low | Solyc11g005490.1.1 | Glyma.08G183700.1 |
| AT2G21430 | Probable cysteine protease RD19B | 5280.58 | 35.2322 | 1304.3 | Low | NA | Glyma.12G039400.1 & Glyma.11G113500.1 |
| AT2G20870 | cell wall protein precursor, putative | 4619.178 | 37.3608 | 5941.6 | Low | Solyc07g054310.1.1 | Glyma.06G296300 & Glyma.13G299400 |
| AT5G44700 | LRR receptor-like serine/threonine | 4325.232 | 32.3737 | 3199.1 | Low | NA | NA |
| AT1G02065 | Squamosa promot binding-like protein 8 | 3580.049 | 73.3987 | 4768.6 | Low | Solyc10g018780.1.1 | Glyma.03G117500.1 |
| AT3G55780 | Glycosyl hydrolase superfamily protein | 3068.954 | 6.18369 | 703.24 | Low | Solyc11g072230.1.1 | Glyma.02G253800.1 |
| AT3G15400 | ATA20 protein quite specific to anthers, | 2985.405 | 140.563 | 1199.6 | Low | NA | NA |
| AT5G21150 | ARGONAUTE 9 this | 6163.265 | 24.0332 | 5210.9 | Low-Medium | Solyc07g049500.2.1 & others | Glyma.13G193200 & others |
| AT2G13680 | Callose synthase 5 - | 5603.663 | 49.2094 | 2351.4 | Low-Medium | Solyc11g005980.1.1 | Glyma.05G191600.1 |
| AT3G04620 | Alba DNA/RNA- | 5541.26 | 100.55 | 1382.5 | Low-Medium | Solyc01g097050.2.1 | Glyma.10G163500.1 |
| AT1G06520 | Glycerol-3-phosphate acyltransferase 1 | 3855.027 | 124.662 | 2889.1 | Low-Medium | Solyc07g056320.2.1 | Glyma.14G028300.1 |
| AT1G04880 | High mobility group B protein 15 | 3662.4 | 11.7178 | 734.57 | Low-Medium | Solyc09g091960.2.1 | Glyma.10G294100.6 |
| AT5G47590 | Heat shock protein HSP20 | 3029.402 | 24.7868 | 3088.8 | Low-Medium | Solyc08g078720.2.1 | NA |
| AT5G67460 | O-Glycosyl | 6067.154 | 156.801 | 5417 | Medium | NA | Glyma.11G048700.1 |
| AT1G02190 | Protein CER1-like 1 | 4337.491 | 39.9606 | 5336.8 | Medium | Solyc12g100270.1.1 & and others | Glyma.03G101200 & others |
| AT5G44620 | Cytochrome P450, family | 4263.19 | 16.2129 | 4746.7 | Medium | Solyc08g079280.2.1 + 9 others | Glyma.17G134100.1 & Glyma.17G134200.1 |

TABLE 28-continued

| Gene | Description | Avg Meiocyte | Seed-ling | Anther | SAM | Tomato Ortholog | Soy Ortholog |
|---|---|---|---|---|---|---|---|
| AT3G53310 | B3 domain-containing protein REM20 | 3620.772 | 101.54 | 4419.7 | Medium | Solyc01g106230.2.1 & others | Glyma.12G048500 & others |
| AT2G35310 | Transcriptional factor B3 family protein | 3147.51 | 49.3908 | 2524.9 | Medium | Solyc01g108930.2.1 | NA |
| AT3G11000 | DCD (Development and Cell Death) domain protein | 3095.287 | 73.4254 | 2989.1 | Medium | Solyc06g050610.1.1 | NA |
| AT1G02800 | CELLULASE 2; Endoglucanase 1 | 5712.925 | 142.641 | 2375.9 | Medium High | Solyc01g110340.2.1 & and others | Glyma.10G017000 & Glyma.19G212700 & Glyma.03G216100 & Glyma.02G016400 |
| AT5G09970 | Cytochrome P450 78A7 | 4392.721 | 17.1479 | 3895.6 | Medium High | Solyc12g056810.1.1 | NA |

Example 9: Tomato FMOS Promoters

Tomato (*Solanum lycopersicum*) promoter candidates (Table 29) were identified by mining the scientific literature and public gene expression datasets for genes with high expression in floral meristems (FM) and low/no expression in vegetative meristems (VM). Tomato meristem gene expression data was obtained from Lemmon Z H et al. (2016) The evolution of inflorescence diversity in the nightshades and heterochrony during meristem maturation. Genome Res. December; 26 (12): 1676-1686, while callus, pistil, sperm cell and microspore gene expression values were taken from Liu L et al. (2018) Transcriptomics analyses reveal the molecular roadmap and long non-coding RNA landscape of sperm cell lineage development. Plant Journal. October; 96 (2): 421-437. For each dataset, quartiles were calculated using the complete matrix of count values for all detected genes. The quartiles provide thresholds for classifying individual gene expression values as low (less than first quartile), medium (between first and third quartiles), and high (expression value greater than third quartile). Many top candidates belonged to the SEPALLATA family, but only one gene was chosen from this family in order to increase the functional diversity of the tested promoters. The callus, pistil, sperm cell and microspore cell expression were also noted.

For screening of these candidate three tomato FMOS promoters, the promoters and terminators of LOXA (Solyc08g014000), UFO (Solyc02g081670), TM5/SEP3 (Solyc05g015750), and TM29/SEP1 (Solyc02g089200) are used to drive the expression of Cas9 enzyme and separately a guide RNA targeting the tomato ADH1 gene (5'-gctgcggttgcatgggaagc-3' (SEQ ID NO: 716) is used constitutively expressed using the *Arabidopsis* U6 promoter, as in Example 1 for maizeconstruct 24879 (which was used to test prUFO/tUFO); the selectable marker Spectinomycin is under the control of the *Glycine max* Elongation Factor promoter. The analysis of the editing efficiency and floral mosaicism was is performed similar to Example 1-4, except that instead of different tassel samples, samples are collected from anthers from mature flowers of the tomato from different locations all around the plant. The T0 analysis, the pollen/anther sequencing and the T1 seedling sequence analysis is performed similarly. Mosaicism scores are calculated using the position of the flower/fruit from which T1 seeds are harvested to make a plant map, and then using the NGS results after batch-germination and target-site genotyping to calculate the score.

Example 10: Soybean FMOS Promoters

Soybean (*Glycine max*) promoter candidates (Table 30) were identified by mining the scientific literature and public

TABLE 29

| Gene | Gene Id | Callus Exp | VM Exp | TM Exp | FM Exp | SIM Exp | Pistil Exp | Sperm Cell Exp | Microspore Exp |
|---|---|---|---|---|---|---|---|---|---|
| Linoleate 9S-lipoxygen A (LOXA) | Solyc08g014000 | Low/off | Low/Medium | High | High | High | High | Off | Medium |
| ANANTHA (AN)/Unusual Floral Organ (UFO) | Solyc02g081670 | ND | Off | Low/off | High | Medium | ND | ND | ND |
| Ortholog of Arabidopsis gene SEP3 (SEPALLATA3) | Solyc05g015750 | Low/off | Off | Off | Medium | Off | High | Off | High |
| TM29; Ortholog of Arabidopsis SEP1 (SEPALLATA1) | Solyc02g089200 | Low | Off (ear mid, lat | Low/off | Medium-high | Medium-low | High | Off | Medium |

VM = early/mid/late vegetative meristem,
TM = transition meristem,
FM = floral meristem
SIM = sympodial inflorescence meristem,
ND = no data;
exp = expression gene expression datasets for genes involved in meiosis and/or with specific expression in inflorescence meristems (IM). For all genes except GmMADS28, gene expression data was taken from Wang L et al. RNA-seq analyses of multiple meristems of soybean: novel and alternative transcripts, evolutionary and functional implications. BMC Plant Biol. 2014; 14: 169. In this paper, they performed mRNASeq analysis of 11 soy tissues: root tip, hypocotyl, cotyledon, callus, shoot apical meristem at 6, 17 and 38 day stage (SAM6D, SAM17D and SAM38D), axillary meristem (AM), inflorescences before and after the meiotic stage (IBM and IAM, similar to the *Arabidopsis* inflorescences at stages 1-9 and 9-12, respectively), and open flower (OF). Genes were classified as low, medium, or high expression according to a simple scheme that utilized expression values for all gene candidates: low=less than the midpoint of all expression values, medium=at or near the 50$^{th}$ percentile, high=greater than the midpoint of all expression values. In addition, promoters were identified and prioritized if their genes had high expression during meiosis or a defined role in meiosis (e.g. MS5 and MMD1 are both known to be involved in meiosis and expressed in meiocytes based on data from other species). Expression values for GmMADS28 were obtained from Phytozome, Genevestigator, and in situ hybridization data from nlm.nih.gov/pmc/articles/PMC4021551/.

expressing the Cas9 nuclease. In these vectors the selectable marker CP4EPSPS under the control of the *Arabidopsis thaliana* EF1aA1 promoter and the PsE9 terminator was used to select for positive transformants. Two guide RNAs targeting the soybean gene GmCenH3 (Glyma.07G057300) were selected: gRNA1 (SEQ ID NO: 515: ATACCGGATTGCGAGAAGC) targets the 1st exon, gRNA2 (SEQ ID NO: 516: GAAGGAAGAAGAGGCGCAAT) targets the 4th exon. These guide RNAs were also included in the construct driven by *Arabidopsis thaliana* and soy U6 promoters, respectively. As a control, one construct utilized the soybean GmEF (Elongation Factor) promoter was used to drive the expression of the Cas9 cassette constitutively, using a tNos terminator.

After selection and regeneration, several putatively transformed plants from each of the five constructs (four FMOS and one constitutive) were grown and sampled for Taqman qPCR assay to test the presence of the transgene as well as to examine whether the guide RNA target sites in the gene were edited. Stably transformed but unedited plants from FMOS constructs were then kept until flowering, and the progeny plants were tested for target site mutations via qPCR assay. Those plants with putative edits were then sequenced and the diversity of different mutations were

TABLE 30

| Gene Name | Gene Id (Soy v1/v2) | SAM Exp. | Early IM Exp. | Late IM Exp. | Cotyledon Exp. | Source |
|---|---|---|---|---|---|---|
| GmMADS28 | Glyma18g00801/ Glyma.18G004700 | Off | On | On | Low-Off | Paper: ncbi.nlm.nih.gov/pmc/articles/PMC4021551/ |
| GmFULa | Glyma06g22650/ Glyma.06G205800 | Low | Medium | Medium | Med-Low | Paper: rd.springer.com/article/10.1007%2Fs002014-1693-5 |
| GmMS5 | Glyma08g47070/ Glyma.08G355900 | Low | Medium | Medium | Medium | Paper: ncbi.nlm.nih.gov/pmc/articles/PMC4070088/ |
| GmMMD1 | Glyma02g41020/ Glyma.02G243200 | Low | Low | Low | Low | Paper: ncbi.nlm.nih.gov/pmc/articles/PMC4070088/ |

These four soybean promoters (including 5' UTR and introns and first exons) and terminators (including 3' UTRs) were selected and installed in binary cassettes for stable transformation of soybean (*Glycine max*) variety "Jack" checked. A very large diversity of mutations were recovered in the progeny families for each event of the four FMOS promoter constructs. In contrast, very few different mutations were recovered in the progeny of the control construct.

TABLE 31

Summary of constructs and T0 and T1 data

| Construct | Gene | Promoter/Terminator Construct Design | Early or Late Floral expression? | Male/ Female specific? | Leaf Editing at T0 plant | PCR sequencing |
|---|---|---|---|---|---|---|
| 24905 | GmEF | prGmEF/tNOS | Constitutive Promoter (control) | | 1 out of 11 in gRNA2; 0 in gRNA1 | E0: gRNA1, WT/WT gRNA2, WT/Ins C E1: to be sequenced (only 2 pods) |
| 24857 | GmMADS28 | prGmMADS28: 2 kb upstream from ATG + 1st exon + 1st intron + first 15bp in 2nd exon; tGmMADS28: 1 kb downstream of stop | Primordia | Male and Female Expressed | 3 T0 plants none edited at either gRNA sites. | T1 plants from 1 T0 event were edited. gRNA1, 4 editing types gRNA2, ≥10 editing types |
| 24925 | GmMMD1 | prGmMMD1: 1.7 kb upstream from ATG + first exon without ATG + first intron + first 15bp in second exon); tGmMMD1: 1 kB downstream of stop codon including 3'UTR | Meiocytes (pre-metioic cells) | Male and Female Expressed | 7 T0 plants none edited at either gRNA sites | All T0 plants produced T1 offspring that were edited. Numerous diverse editing types in all families |

Figure 35:
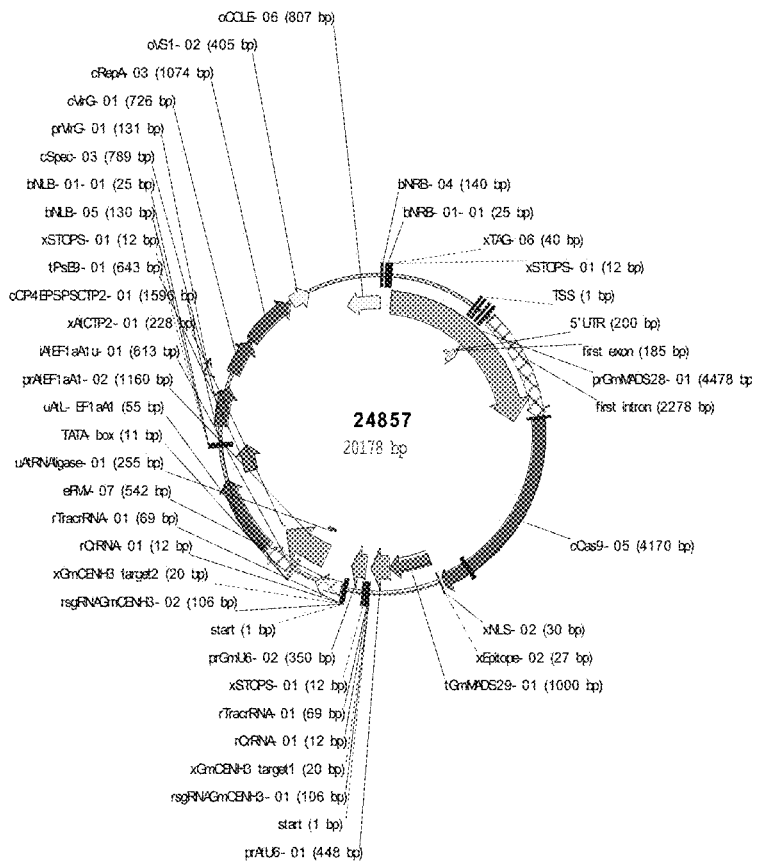
FIG. 35 is a schematic drawing of Vector 24857 (SEQ ID NO: 513) used for transformation of soybean.

In construct 24857 (FIG. 35, SEQ ID NO: 513) and 24925 (SEQ ID NO: 657), the SpCas9 gene was soy codon-optimized with NLS at the 3' end and driven by candidate FMOS promoters and terminators. For construct 24857, the prGmMADS28 promoter and tGmMADS28-01 terminator controlled Cas9 expression. For construct 24925, the prGmMMD1 promoter and tGmMMD1 terminator was used to control Cas9 expression. The two gRNAs were driven by Arabidopsis U6 and Soybean U6, which was synthesized by GenScript (genscript.com) and cloned into the binary vector which including the EPSPS driven by Arabidopsis EF-1 alpha A1 promoter with eFMV enhancer as the selection marker. Similarly for 24905 (FIG. 36, SEQ ID NO: 514), same SpCas9 was driven by prGmEF, and the tNOS was selected as the terminator. Soy variety Jack was used for transformation based on public method (Watts J. and Ganesan S. U.S. Pat. No. 9,758,792, Sep. 12, 2017). Plants survived from EPSPS selection went to Taqman check on cCP4EPSPSCTP2 and cCas9. Taqman check performed as 95° C. for 5 minutes hold 40 cycles of: 95° C., 5 seconds 60° C., and 30 seconds in ABI7900HT Fast System (see Table XBOX for primer sequences)

TABLE 32

Sequences for Taqman assays cCP4EPSPSCTP2 assay

| | |
|---|---|
| Sense primer | AACGGTGTTGATTGCGATGA (SEQ ID NO: 522) |
| Antisense primer | GCTGCTCCAGAAGCGTTACC (SEQ ID NO: 523) |
| Probe | 5'FAM-ACTTCTCTCGTCGTGCGTGGTCGTC-3'BHQ1 (SEQ ID NO: 524) | cCas9 assay

| | |
|---|---|
| Sense primer | CAAGTTTCTGGACAAGGAGATTCTC (SEQ ID NO: 525) |
| Antisense primer | AAGAATTCCCTTCTTAATAGCTGGAGA (SEQ ID NO: 525) |
| Probe | 5'FAM-CACGAGCACATTGCTAACCTTGCTGG-3'BHQ1 (SEQ ID NO: 526) |

Plants were selected when Taqman results were positive in both assays and sent to GH. All T0 plants were grown in SBC greenhouse at temperature of 25° C. (day, 14h)/20° C. (dark, 10h) and an average photon flux are more than 300 mmol m−2 s−1 supplied by the high-pressure sodium lamp. T1 seeds were harvested after allowing self-pollination of the T0 plants.

TABLE 33

Taqman data of 24857 T0 plants and T1 seeds harvested

| T0 plant ID | cCP4EPSPSCTP2-01 | cCas9-05 | No. of T1 seeds |
|---|---|---|---|
| SYKE191119A003A | 2 | 2 | 32 |
| SYKE191119A011A | >2 | >2 | 32 |
| SYKE191119B011A | 1 | 1 | 58 |

TABLE 34

Taqman data of 24925 T0 plants and T1 seeds harvested

| T0 plant ID | cCP4EPSPSCTP2-01 | cCas9-05 | No of T1 seeds |
|---|---|---|---|
| SYKE191900A005A | >2 | 2 | Many |
| SYKE191900A009A | 1 | 2 | seeds were |
| SYKE191900A010A | 2 | 2 | harvested |
| SYKE191900A012A | 1 | 1 | from these |
| SYKE191900A022A | 1 | 1 | events - |
| SYKE191900A023A | 1 | 1 | see next |
| SYKE191900A025A | >2 | 2 | table |

Young leaf samples of T0 were collected at flowering stage. Genomic DNA was isolated using MagneSil™ Paramagnetic Particles. One amplicon covering both gRNA1 and gRNA2 was amplified by CENH3 forward primer (PF) (SEQ ID NO: 628) and CENH3 reverse primer PR (SEQ ID NO: 629). The PCR reactions using KOD-plus-neo (Toyobo) were performed as the following process: 95° C. 3 min; 94° C. 15 sec, 63° C. 20 sec, 68° C. 50 sec, 30 cycles; 68° C. 2 min. Through Sanger sequencing with CENH3 SeqF primer (SEQ ID NO: 630), we are able to read the both gRNA1 and gRNA2 target sequence in one reaction. Only 1 T0 plant generated from construct 24905. No editing happened at gRNA1 locus; in gRNA2, one allele was edited. Three T0 plants from construct 24857 were checked using leaf samples collected from flowering time, both gRNA1 and gRNA2 were not edited.

| | Sequencing data of 24905 T0 at gRNA2 locus | |
|---|---|---|
| WT | GAAGGAAGAAGAGGCGC-AATAGG | (SEQ ID NO: 655) |
| Edit 1 | GAAGGAAGAAGAGGCGCCAATAGG | (insertion of a C) (SEQ ID NO: 656) |

TABLE 35

Germination rate of 24857 T1 plants (prGmMADS28)

| T0 plant ID | No. of T1 seeds | Germination rate (%) | No. of T1 plants for Taqman | No. of Taqman+ T1 plants | No. of T1 plants edited |
|---|---|---|---|---|---|
| SYKE191119A003A | 32 | 91 | 29 | 23 | 0 |
| SYKE191119A011A | 32 | 97 | 31 | 19 | 0 |
| SYKE191119B011A | 58 | 78 | 45 | 25 | 18 |

T1 plants of the three events were sampled and the cCP4EPSPSCTP2 and cCas9 assays were used to find out which plants carried the editing transgene (Table 35) and then plants were checked for edits by target site colony sequencing (average 15 clones/sample). The Sanger sequencing data were analyzed with vector NTI software. Sequencing of T1 plants follows same process but using leaves collected at V3 stage. Among 18 T1 plants of SYKE191119B011A, in gRNA2 locus, there are more than 10 editing types (Table PRR % and Fig QST). Due to this diversity of editing types recovered in the offspring, the promoter in this event is clearly acting as a good quality FMOS promoter. The other two events showed no editing.

could have been triggered in the gametophytic stage of flower development prior to fertilization (either the male, or female or both). This may reflect the true activity of the promoter although it may also be less than the actual edits made—because these edits care being made in an essential developmental gene (CenH3), many of the actual edits made could be lost either through the failure of transmission of the edited allele through either the male or female reproductive lineage or through the failure of flowers or seed to develop in the edited plant sectors.

TABLE 36

Taqman and sequencing data of edited SYKE191119B011A T1 plants at the gRNA2 locus

| T1 plant ID | GmCenH3-gRNA2 | cCP4EPSPSCTP2 | cCas9 |
|---|---|---|---|
| B011A-11 | WT/LOF (Ins A) | 1 | 1 |
| B011A-12 | WT/LOF (Ins A) | 1 | 1 |
| B011A-13 | WT/LOF (Ins A) | 1 | 1 |
| B011A-14 | WT/LOF (ΔAA) | 1 | 1 |
| B011A-16 | WT/LOF (ΔAA) | 1 | 1 |
| B011A-17 | WT/LOF ΔCGCAATAGGTCGGGAACTGTGG (Δ22nt) (SEQ ID NO: 658) | 1 | 1 |
| B011A-18 | WT/LOF (ΔACGCAA)(SEQ ID: 659) | 1 | 1 |
| B011A-25 | WT/Δ3aa(ΔGAGGCGCAA) (SEQ ID: 660) | 2 | 2 |
| B011A-28 | WT/LOF (ΔAA) | 2 | 2 |
| B011A-30 | WT/LOF (ΔCGCAATAGGTCGGGAACTGTGG (Δ22nt) (SEQ ID NO: 658) | 1 | 1 |
| B011A-32 | WT/LOF (Ins G) | 1 | 1 |
| B011A-36 | WT/LOF (ΔAATAG) (SEQ ID NO: 661) | 1 | 1 |
| B011A-4 | WT/LOF (ΔGC) | 1 | 1 |
| B011A-40 | WT/Δ1aa (ΔGCA) | 1 | 1 |
| B011A-41 | WT/Ins 2nt (TBD) | 1 | 1 |
| B011A-44 | WT/LOF (ΔCGCAATAGGTCGGGAACTGTGG (Δ22nt) (SEQ ID NO: 658) | 1 | 1 |
| B011A-5 | Δ1aa (ΔCGC)/LOF (Ins n) | 1 | 1 |

Figure 36:
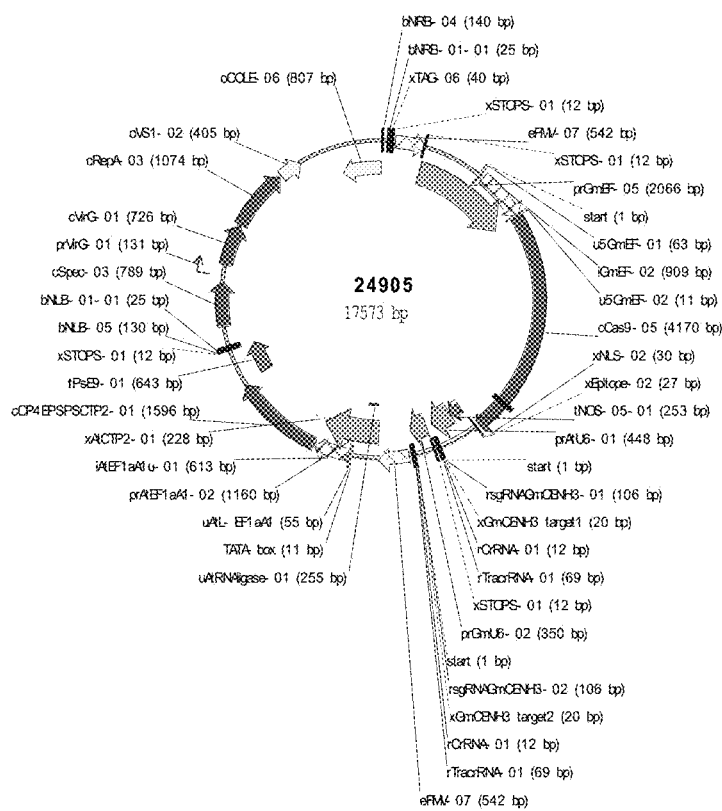
FIG. 36 is a schematic drawing of Vector 24905 (SEQ ID NO: 514) used for transformation of soybean.

These plants all were 1 or 2 copy Cas9. Out of 45 El plants checked, 20 had no Cas9 or editing, 23 had 1 copy of the Cas9 transgene and of these 16 were edited in one allele (heterozygous) and 2 had 2 copies of the Cas9 transgene and of these both were edited (again, heterozygous). Based on the inability to find edits in the T1 without Cas9 (and based on the absence of chimerism in the T1), we suspect edits FIG. 36 illustrates sequencing data of 24857 T1 at gRNA2 locus. Additionally, there were edits made at the gRNA1 locus, although the overall editing efficiency is lower in gRNA1 compared to that in gRNA2; only 4 editing types were identified in gRNA1 locus among 25 transgenic T1 plants from SYKE191119B011A (Table 37).

TABLE 37

Sequencing data of edited SYKE191119B011A T1 plants at gRNA1 locus

| T1 plant ID | GmCenH3-gRNA1 (WT = CCAGCTTCTCGCAAATCCGGTAT)(SEQ ID NO: 662) |
|---|---|
| B011A-12 | WT/LOF (Ins T) (CCAGCTTTCTCGCAAATCCGGTAT)(SEQ ID NO: 663) |
| B011A-22 | WT/LOF (Ins A) (CCAGCTATCTCGCAAATCCGGTAT) (SEQ ID NO: 664) |
| B011A-25 | WT/ΔTTC + Ins AAATTCGCAGCTAAAAAGCAAGCGTTGAATCCGAAGAGTGAAGGT(SEQ ID NO: 666) |
| B011A-28 | WT/LOF (ATC) ((CCAGCT---TCGCAAATCCGGTAT) (SEQ ID NO: 666) |

Examining the promoter prGmMMD1 (construct 24925) (FIG. 34), seven events were maintained through seed production and all seven did not have any editing in the T0 leaf at the seedling or early flowering stage. In the T1 generation, Table 38 describes the number of seeds planted (seed production was generally higher in this construct than in the prior two), the number germinated and sampled for Taqman, and the number of T0 plants that were Taqman+ for the Cas9 transgene, as well as the number of edited plants (although several plants remain to be sequenced—we didn't check every one).

TABLE 38

Germination rate of 24925 T1 plants and edited T1 plants in gRNA2 locus

| T0 plant ID | T1 planted | Germination rate (%) | Sampled plants | Cas9+ plants | No. of T1 plants edited (gRNA2) |
|---|---|---|---|---|---|
| SYKE191900A005A | 60 | 83 | 50 | 47 | 9 (13 not sequenced) |
| SYKE191900A009A | 60 | 88 | 53 | 36 | 17 (14 not sequenced) |
| SYKE191900A010A | 60 | 93 | 56 | 48 | 31 (10 not sequenced) |
| SYKE191900A012A | 60 | 80 | 48 | 35 | 19 (2 not sequenced) |
| SYKE191900A022A | 60 | 88 | 53 | 35 | 22 |
| SYKE191900A023A | 60 | 87 | 52 | 35 | 25 (4 not sequenced) |
| SYKE191900A025A | 60 | 73 | 44 | 40 | 28 (6 not sequenced) |

Figure 37:
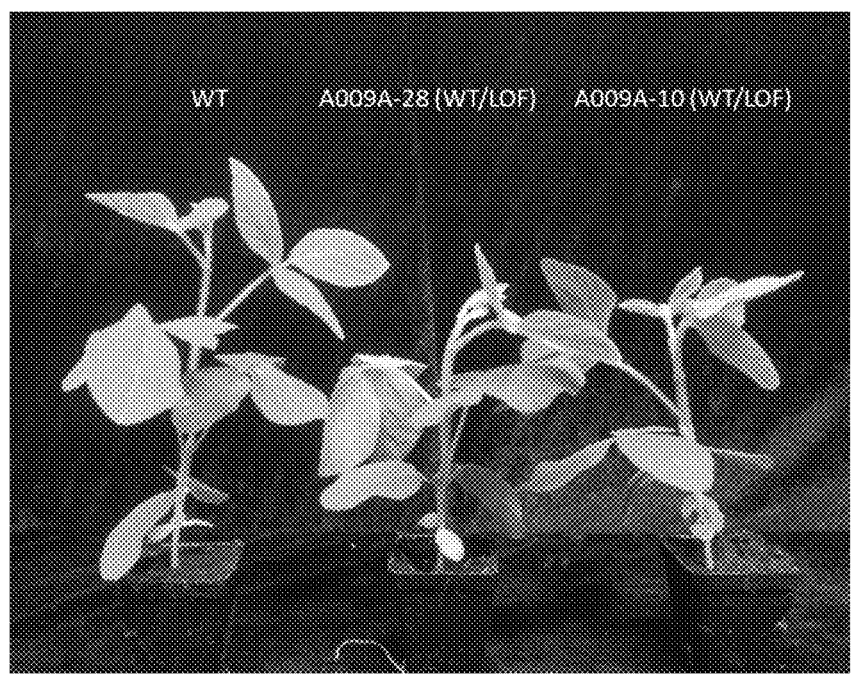
FIG. 37 is a photograph of T1 plants.

Among T1 progeny of event SYKE191900A005A, we identified 4 mutation types in gRNA2 locus (FIG. 8) out of 34 plants. Most edited T1 plants had at least one WT allele of CenH3, so the phenotype is similar as WT plant (FIG. 37). FIG. 37 is a photograph demonstrating phenotypes of T1 plants of SYKE191900A009A

TABLE 39 sequencing data of T1 plants of SYKE191900A005A at gRNA2 locus

| WT | AGGCTCAGGGAAGGAAGAAGAGGCGC-AATAGGTCGGGAACTGTGGCGCTTCGTGAGA (SEQ ID NO: 667) |
|---|---|
| Edit 1 | AGGCTCAGGGAAGGAAGAAGAGGCGCAAATAGGTCGGGAACTGTGGCGCTTCGTGAGA InsA (SEQ ID NO: 668) |
| Edit 2 | AGGCTCAGGGAAGGAAGAAGAGGCGCTAATAGGTCGGGAACTGTGGCGCTTCGTGAGA InsT (SEQ ID NO: 669) |
| Edit 3 | AGGCTCAGGGAAGGAAGAAGAGGCGC--ATAGGTCGGGAACTGTGGCGCTTCGTGAGA ΔA (SEQ ID NO: 670) |
| Edit 4 | AGGCTCAGGGAAGGAAGAA-------GCTTCGTGAGA Δ27nt (SEQ ID NO: 671) |

Seventeen out of thirty-nine sequenced T1 progeny of event SYKE191900A009A were edited, and there were 10 distinct alleles identified (Table 40). Most types are insertions of 1nt to deletions from 1nt to 8 nt.

TABLE 40

| | | |
|---|---|---|
| WT | AGGCTCAGGGAAGGAAGAAGAGGCGC-AAT<u>AGG</u>TCGGGAACTGTGGCGCTTCGTGAGA | (SEQ ID NO: 672) |
| Edit 1 | AGGCTCAGGGAAGGAAGAAGAGGCGCAAAT<u>AGG</u>TCGGGAACTGTGGCGCTTCGTGAGA InsA | (SEQ ID NO: 673) |
| Edit 2 | AGGCTCAGGGAAGGAAGAAGAGGCGCAAT<u>AGG</u>TCGGGAACTGTGGCGCTTCGTGAGA InsC | (SEQ ID NO: 674) |
| Edit 3 | AGGCTCAGGGAAGGAAGAAGAGGCGCTAAT<u>AGG</u>TCGGGAACTGTGGCGCTTCGTGAGA InsT | (SEQ ID NO: 675) |
| Edit 4 | AGGCTCAGGGAAGGAAGAAGAGGCGC--AT<u>AGG</u>TCGGGAACTGTGGCGCTTCGTGAGA ΔA | (SEQ ID NO: 676) |
| Edit 5 | AGGCTCAGGGAAGGAAGAAGAGGCG--AAT<u>AGG</u>TCGGGAACTGTGGCGCTTCGTGAGA ΔAC | (SEQ ID NO: 677) |
| Edit 6 | AGGCTCAGGGAAGGAAGAAGAGGCGC---<u>AGG</u>TCGGGAACTGTGGCGCTTCGTGAGA ΔAAT | (SEQ ID NO: 678) |
| Edit 7 | AGGCTCAGGGAAGGAAGAAGA-----AT<u>AGG</u>TCGGGAACTGTGGCGCTTCGTGAGA | (SEQ ID NO: 679) |
| Edit 8 | AGGCTCAGGGAAGGAAGAAGAGG--AAT<u>AGG</u>TCGGGAACTGTGGCGCTTCGTGAGA ΔCGC | (SEQ ID NO: 680) |
| Edit 9 | AGGCTCAGGGAAGGAAGAAGA-----AT<u>AGG</u>TCGGGAACTGTGGCGCTTCGTGAGA | (SEQ ID NO: 681) |
| Edit 10 | AGGCTCAGGGAAGGAAGAA-----AT<u>AGG</u>TCGGGAACTGTGGCGCTTCGTGAGA | (SEQ ID NO: 682) |

Thirty-one out of forty-six sequenced T1 progeny of event SYKE191900A010A were edited, and there were 13 distinct alleles identified (Table 41).

TABLE 41

| | | |
|---|---|---|
| WT | AGGCTCAGGGAAGGAAGAAGAGGCGC-AAT<u>AGG</u>TCGGGAACTGTGGCGCTTCGTGAGA | (SEQ ID NO: 683) |
| Edit 1 | AGGCTCAGGGAAGGAAGAAGAGGCGCAAAT<u>AGG</u>TCGGGAACTGTGGCGCTTCGTGAGA InsA | (SEQ ID NO: 684) |
| Edit 2 | AGGCTCAGGGAAGGAAGAAGAGGCGCCAAT<u>AGG</u>TCGGGAACTGTGGCGCTTCGTGAGA InsC | (SEQ ID NO: 685) |
| Edit 3 | AGGCTCAGGGAAGGAAGAAGAGGCGCTAAT<u>AGG</u>TCGGGAACTGTGGCGCTTCGTGAGA InsT | (SEQ ID NO: 686) |
| Edit 4 | AGGCTCAGGGAAGGAAGAAGAGG---AAT<u>AGG</u>TCGGGAACTGTGGCGCTTCGTGAGA ΔCGC | (SEQ ID NO: 687) |
| Edit 5 | AGGCTCAGGGAAGGAAGAAGAGGCGC----T<u>AGG</u>TCGGGAACTGTGGCGCTTCGTGAGA ΔAA | (SEQ ID NO: 688) |
| Edit 6 | AGGCTCAGGGAAGGAAGAAGAGGC---AAT<u>AGG</u>TCGGGAACTGTGGCGCTTCGTGAGA ΔGC | (SEQ ID NO: 689) |
| Edit 7 | AGGCTCAGGGAAGGAAGAAGAGGC--AT<u>AGG</u>TCGGGAACTGTGGCGCTTCGTGAGA ΔGCA | (SEQ ID NO: 690) |
| Edit 8 | AGGCTCAGGGAAGGAAGAAGA----AAT<u>AGG</u>TCGGGAACTGTGGCGCTTCGTGAGA Δ5 | (SEQ ID NO: 691) |
| Edit 9 | AGGCTCAGGGAAGGAAGAAGA---AT<u>AGG</u>TCGGGAACTGTGGCGCTTCGTGAGA Δ6 | (SEQ ID NO: 692) |
| Edit 10 | AGGCTCAGGGAAGGAAGAAGAGGCGC---GTCGGGAACTGTGGCGCTTCGTGAGA Δ5 | (SEQ ID NO: 693) |
| Edit 11 | AGGCTCAGGGAAGGAAGAAGAGG-----TCGGGAACTGTGGCGCTTCGTGAGA Δ9 | (SEQ ID NO: 694) |
| Edit 12 | AGGCTCAGGGAAGGAAGAA----T<u>AGG</u>TCGGGAACTGTGGCGCTTCGTGAGA Δ9 | (SEQ ID NO: 695) |
| Edit 13 | AGGCTCAGGGAAGGAAGAAGAGGC------------GCTTCGTGAGA Δ22nt | (SEQ ID NO: 696) |

Thirty-one out of forty-six sequenced T1 progeny of event SYKE191900A010A were edited, and there were 10 distinct alleles identified. For the remaining T1 plants of the other four events, each had more than 10 mutation types at the gRNA2 target site. Guide RNA1 target site was not edited. The different alleles are shown in Table 42.

TABLE 42

Mutation type summary of T1 plants from left 4 events.

| No. | SYKE191900A012A | SYKE191900A022A | SYKE191900A023A | SYKE191900A025A |
|---|---|---|---|---|
| 1 | Δ22nt | Δ11nt | Δ12nt | Δ11nt |
| 2 | Δ3nt (ΔAAT) | Δ17nt | Δ14nt | Δ1nt (ΔA) |
| 3 | Δ3nt (ΔCGC) | Δ1nt (ΔC) | Δ15nt | Δ1nt (ΔC) |
| 4 | Δ6nt | Δ22nt | Δ22nt | Δ22nt |
| 5 | Δ6nt | Δ2nt (ΔAA) | Δ2nt (ΔAA) | Δ3nt (ΔCGC) |
| 6 | Δ7nt | Δ2nt (ΔGC) | Δ2nt (ΔCA) | Δ4nt |
| 7 | Δ9nt | Δ3nt (ΔAAT) | Δ2nt (ΔGC) | Δ8nt |
| 8 | Δ9nt) | Δ3nt (ΔCAA) | Δ3nt (ΔAAT) | Δ9nt |
| 9 | ΔGCGC | Δ3nt (ΔCGC) | Δ5nt | Δ9nt |

TABLE 42-continued

Mutation type summary of T1 plants from left 4 events.

| No. | SYKE191900A012A | SYKE191900A022A | SYKE191900A023A | SYKE191900A025A |
|---|---|---|---|---|
| 10 | Ins A | Δ5nt | Δ7nt | Ins C |
| 11 | Ins C | Δ5nt | Δ8nt | Ins T |
| 12 | Ins T | Ins A | ΔA | |
| 13 | | Ins C | Ins A | |
| 14 | | Ins T | Ins T | |

In summary, all 7 events showed FMOS activity from the MMD1 promoter.

Further, embodiments of the disclosure include the use of enhancers to improve FMOS activity. For example, to enhance the editing efficiency (and overall editing rate) of the prGmMMD1-01 promoter, additional floral specific transcription factor binding motifs may be inserted into the MMD1 promoter as exemplified in prGmMMD1-02 (SEQ ID NO: 710). In this example, a synthetic enhancer (SEQ ID NO: 711) driving floral-specific expression is added to the 5' end of the GmMMD1 promoter and also within the promoter near the 3' end (SEQ ID NO: 712). This enhancer was composed of three repeated motifs of the SEPTALLATA3 (AGL3) transcription factor binding motif from Arabidopsis (5'-CCATAAATAG) as well as three repeats of the SEPETALLA1 transcription factor binding motif (5'-TTACCATATATAGAAAT-3'), each separated from each other by six nucleotides (AAGCTT). Additionally, a translational leader sequence—in particular, the Omega sequence from tobacco mosaic virus—or eTMV-03 (SEQ ID NO: 713) was added just at the end of the promoter and before the start codon in the 5' UTR of the cassette. Other examples, include any combination of enhancers chosen from SEQ ID NOs: 711, 712, 713, or enhances having at least 50%, at least 60%, at least 70%, at least 80%, at least 90% or at least 95% identity thereto. As this is 5'-UTR, this sequence becomes part of the Cas9 transcript and enhances translation. Combining enhancement of transcription and translation, through addition of these motifs to functional FMOS promoters like MMD1, gives new promoters (e.g. prGmMMD1-02), which have increased expression of Cas9 in floral tissues and no leaky expression in vegetative meristems in both dicots and monocots. This leads to an increase in overall E0 flower editing efficiency, to a greater recovery of edited variants in offspring, and a higher mosaicism score. In other words, these enhancements can take a "good" FMOS promoter to "excellent" or "elite" on the mosaicism score scale.

Example 11: Efficient Mutagenesis of a Gene Regulatory Network

Embodiments of the invention may also be used to create an allelic series and variety of knockout combinations in a gene regulatory network (GRN). For example, one can create an allelic series and a range of knockout combinations by using an FMOS promoter—paired with a targeted nuclease to edit one or more genes in the GRN (but not all of the genes) to drive Cas9 activity, paired with multiple guide RNAs. The guide RNAs would each be designed to one family member. Due to the low level of expression, the Cas9 may edit one or more genes, but not all eight genes, in each germinal cell lineage—resulting in progeny that have different combinations of alleles in the family. By selfing the T1 to make T2, homozygous mutants for different genes can thus be recovered. There is no similarly straightforward way to create a panel of gene family knockouts with such little effort—using this method.

Embodiments of the invention may also be used to create an allelic series and variety of knockout combinations in a gene regulatory network (GRN). For example, an FMOS promoter paired with a targeted nuclease may be used to edit one or more genes in the GRN (but not all of the genes) resulting in progeny that have different combinations of alleles in the family. By selfing the T1 to make T2, homozygous mutants for different genes can thus be recovered. There is no similarly straightforward way to create a panel of gene family knockouts with such little effort—using this method.

To demonstrate mutagenesis of a gene family, and to understand how different members of a gene family interact, or function redundantly, we created an allelic series and knockout combinations by using the maize APETALA1 (ZmAP1) promoter to drive Cas9 activity, paired with two dual guide RNAs targeting maize Chalcone synthase White Pollen 1 (WHP1, Zm00001d007403 on Chr2) and Chalcone Synthase C2 (Zm00001d052673 on Chr4) genes. Coding sequence of WHP1 and C2 genes share 95% similarity. The first guide RNA targets both genes on their first exon, and the second guide RNA targets both genes on their second exon (see Table 43 for details). Expression of the two guide RNAs and TracrRNA were driven by constitutive Ubi4 promoter from sugarcane, with each RNA flanked by two self-cleavable ribozymes (Hammerhead and HDV) for efficient processing. Vector also contains PMI as the selectable marker. Construct 25053 (SEQ ID NO: 533) has one copy of TracrRNA. A detailed description of construct 25053 is provided below.

| bp position | Component Name | Construct 25053 Description |
|---|---|---|
| 4-143 | bNRB-04 | Right border region of T-DNA of *Agrobacterium tumefaciens* nopaline ti-plasmid. Differs from bNRB-03 by 20 bp at 5' end. |
| 144-183 | xTAG-06 | 40 bp site for plant insert intactness testing and to stop readthrough ORFs. Typically by agro RB. 1 bp different than -01. |
| 184-195 | xSTOPS-01 | 6-frame stop to minimize unintended ORF read-through; |
| 232-4003 | prZmAP1-02 | Promoter sequence of maize APETALA1 (AP1) gene (Zm00001d007949, GRMZM2G148693, Agamous-like MADS-box protein AGL8) from B73v5 for specific expression in early and late male and female inflorescences. |

-continued

| bp position | Component Name | Construct 25053 Description |
|---|---|---|
| | | The sequence includes the upstream promoter, first exon, first intron, and second exon (partial), with 2 bp changes to remove ATG Start codons. Differs from version 01 by an additional one bp change to remove an internal BsmBl site. |
| 4010-8179 | cCas9-02 | *Streptococcus pyogenes* Cas9 (for CRISPR-associated) gene, which is part of an RNA-guided site-directed nuclease system. This is a mutated version of cCas9-01 with 1 silent point mutation (C to T in position 3381 bp) to remove SanDl site. |
| 8191-9190 | tZmAP1-01 | Terminator sequence of maize APETALA1 (AP1) gene (Zm00001d007949) from B73v5. |
| 9198-10999 | prSoUbi4-02 | The constitutive sugarcane ubi4 promoter. prScUbi4-01 with stop codons in all 3 ORFs and with an internal NcoI site removed. |
| 11013-11055 | rHH-03 | Hammerhead RNA; a conserved sequence motif from Satellite RNAs of certain viruses, including Tobacco ringspot virus, responsible for self-cleavage. Pairing sequence with tracrRNA was added at 5' end to ensure proper cleavage. |
| 11056-11128 | rTracrRNA-11 | A modified form of tracrRNA (trans-activating crRNA) from *Streptococcus pyogenes* CRISPR system. Comparing to rTracrRNA-10 in 24155, AA at the 5'end were changed into CC. |
| 11129-11196 | rHDV-01 | A sequence encoding a self-cleavable ribozyme from hepatitis delta virus (HDV) |
| 11203-11208 | pairing sequence | |
| 11209-11245 | rHH-n5 | Hammerhead RNA; a conserved sequence motif from Satellite RNAs of certain viruses, including Tobacco ringspot virus, responsible for self-cleavage. Pairing sequence need to be added at 5' end to ensure proper cleavage. |
| 11246-11289 | rCrRNAZmWHP1C2-n1 | Cas9 crRNA RNA targeting maize White Pollen 1 gene (WHP1 GRMZM2G151227, Zm00001d007403, encoding an Chalconesynthase) and Chaicone synthase C2 (GRMZM2G422750, Zm00001d052673) in the first exon close to the first intronat sequence ACTACCCGGACTACTACTTC (ZmWHP1C2Target1). |
| 11290-11357 | rHDV-01 | A sequence encoding a self-cleavable ribozyme from hepatitis delta virus (HDV). |
| 11367-11372 | pairing sequence | |
| 11373-11409 | rHH-n5 | Hammerhead RNA; a conserved sequence motif from Satellite RNAs of certain viruses, including Tobacco ringspot virus, responsible for self-cleavage. Pairing sequence need to be added at 5' end to ensure proper cleavage. |
| 11410-11453 | rCrRNAZmWHP1-n2 | Cas9 crRNA RNA targeting maize White Pollen 1 gene (WHP1 GRMZM2G151227, Zm00001d007403, encoding an Chalconesynthase) and Chaicone synthase C2 (GRMZM2G422750, Zm00001d052673) in the second exon CCGACTGGAACTCCATCTTC(ZmWHP1C2Target2). |
| 11454-11521 | rHDV-01 | A sequence encoding a self-cleavable ribozyme from hepatitis delta virus (HDV). |
| 11522-11774 | tNOS-05-01 | synthetic Nopaline synthetase terminator |
| 11791-13783 | prUbi1-18 | prUbi1-10 with T to C at nt597, G to A at nt1047, C to T at nt1117 |
| 13791-14966 | cPMI-14 | Synthetic phosphomannose isomerase gene with maize-modified codons. PMI-12 with 5 nucleotide changes (silent) to remove internal cloning sites useful for Beijing and RTP sites: C96A (NcoI), C129A (SacI), C354A (NcoI), C759T (BsaI), C999T (BsaI). |
| 14979-16013 | tUbi1-06 | The terminator from the UBI1 gene from *Zea mays*. Optimized version of tUbi1-01 to remove internal SbfI (C243G) and BsmBI (C502G) sites. |
| 16036-16047 | xSTOPS-01 | 6-frame stop to minimize unintended ORF read-through |
| 16048-16087 | xTAG-02 | 40 bp site for plant insert intactness testing and to stop readthrough ORFs. Typically by agro LB. |
| 16096-16225 | bNLB-05 | Left border region of T-DNA of *Agrobacterium tumefaciens* nopaline ti-plasmid. Differs from bNLB-03 by one base pair to remove ATG start codon for ORF pointing into flanking region. |
| 16505-17293 | cSpec-03 | Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 |
| 17388-17518 | prVirG-02 | virG promoter composed of two promoter elements, one responsive to acetosyringone and phosphate-starvation (bp 45 to 83) and another to medium acidification (86 to 128). Removed BstXI site (C to G) compared with prVirG-01.; 30 |
| 17593-18318 | cVirG-06 | Modified cVirG. Differs from cVirG-01 by single bp (base 255) change: a silent mutation to eliminate internal BsmBl site. |
| 18348-19421 | cRepA-05 | Modified cRepA. Differs from cRepA-01 by base 78 and 390 change: silent mutations to eliminate internal two SfiI sites. |
| 19464-19868 | oVS1-03 | Modified oVS1. Differs from oVS1-02 by base 15 and 243 change: two mutations to eliminate internal BsaI andBspQI sites. |
| 20546-21352 | oCOLE-06 | The ColE1 origin of replication functional in *E. coli* derived from pUC19 |

TABLE 43

| Target Name | Target Sequence | PAM | Chromosome | Location in genome* | Target Gene | Gene ID | Location in target gene |
|---|---|---|---|---|---|---|---|
| Whp1 Cas9 Target 1 | ACTACCCGGACTACTACTTC | CGG | 2 | 230956848-230956826 | Chalcone synthase WHP1 | Zm00001d007403 | First exon |
| C2 Cas9 Target 1 | ACTACCCGGACTACTACTTC | CGG | 4 | 196893557-156893579 | Chalcone synthase C2 | Zm00001d052673 | First exon |
| Whp1 Cas9 Target 2 | CCGACTGGAACTCCATCTTC | TGG | 2 | 230952905-230953883 | Chalcone synthase WHP1 | Zm00001d007403 | Second exon |
| C2 Cas9 Target 2 | ACTACCCGGACTACTACTTC | CGG | 4 | 196895851-156895873 | Chalcone synthase C2 | Zm00001d052673 | Second exon |

*Corresponding location in maize B73 genome V5

SEQ ID NO: 633 is the nucleotide target sequence for Chalcone synthase (WHP1), Target 1. SEQ ID NO: 634 is the nucleotide target sequence for Chalcone synthase (C2), Target 1. SEQ ID NO: 635 is the nucleotide target sequence for Chalcone synthase (WHP1), Target 2. SEQ ID NO: 636 is the nucleotide target sequence for Chalcone synthase (C2), Target 2.

We transformed WT JHAX plants with construct 25053 following standard protocol, through *Agrobacterium* mediated transformation of immature embryos (MZKE193004A). Transformation frequency was 27.87%. A total number of 32 plants were sent to green house, Plants were grown to maturity for pollination to generate T1 seeds. Since editing of Chalcone Synthase genes will affect pollen fertility, pollen grains from TO plants were treated with flavonoid before pollination. (details in flavonoid treatment). T1 embryos were isolated followed by DNA extraction and analysis. Gene- and target-specific Taqman assays were designed to detect editing in each of the two family members (see Table 44 for details).

sequence for a probe for C2, Target 1. SEQ ID NO: 643 is a nucleotide sequence for primer 1 for WHP1, Target 2. SEQ ID NO: 644 is a nucleotide sequence for primer 2 for WHP1, Target 2. SEQ ID NO: 645 is a nucleotide sequence for a probe for WHP1, Target 2. SEQ ID NO: 646 is a nucleotide sequence for primer 1 for C2, Target 2. SEQ ID NO: 647 is a nucleotide sequence for primer 2 for C2, Target 2. SEQ ID NO: 648 is a nucleotide sequence for a probe for C2, Target 2.

In the T1 seeds, we identified three offspring of event GVG01194901 that had distinct editing patterns (Table 16, first three rows). Plant 44 had a 1 bp insertion in the C2 gene; plant 77 had a different 1 bp insertion in the WHP1 gene, and plant 91 had a 24 bp deletion in C2. Similarly, in event GVG01194902, among six offspring, there were five different editing patterns in the two genes. From event GVG01194908, among seven offspring there were four different editing patterns, including one plant that had edits in both the C2 and WHP1 genes (the others had edits in one

TABLE 44

| Target Name | Assay Sequence | Primer 1 name | Primer 1 sequence | Primer 2 name | Primer 2 sequence | Probe name | Probe sequence |
|---|---|---|---|---|---|---|---|
| Whp1 Cas9 Target 1 | 3589 | 33229-FE12420 | CCATCGGGACGGCGA | 33230-FE12421 | CTTGAGGTCGGTGAGGTGG | 33231-FE12422 | CTACTACTTCCGGATCAC |
| C2 Cas9 Target 1 | 3591 | 33232-FE12423 | CGATCGGCACCGCCA | 33233-FE12424 | CTTGAGGTCGGTGAGGTGC | 33231-FE12422 | CTACTACTTCCGGATCAC |
| Whp1 Cas9 Target 2 | 3590 | 33234-FE12425 | GCTGGAGGACGCGTTCG | 33235-FE12426 | TGGCCTCCACCTGGTCC | 33236-FE12427 | ACTCCATCTTCTGGGTGG |
| C2 Cas9 Target 2 | 3592 | 33237-FE12428 | GCTGGACGACGCGTTCA | 33238-FE12429 | TGGCCTCCACCTGGTCG | 33236-FE12427 | ACTCCATCTTCTGGGTGG |

*Letters in red in C2 primers are bases different from corresponding ones in Whp1 primers SEQ ID NO: 637 is a nucleotide sequence for primer 1 for WHP1, Target 1. SEQ ID NO: 638 is a nucleotide sequence for primer 2 for WHP1, Target 1. SEQ ID NO: 639 is a nucleotide sequence for a probe for WHP1, Target 1. SEQ ID NO: 640 is a nucleotide sequence for primer 1 for C2, Target 1. SEQ ID NO: 641 is a nucleotide sequence for primer 2 for C2, Target 1. SEQ ID NO: 642 is a nucleotide gene or the other but not both). From event GVG01194912, there were five edited offspring with four different editing patterns. It is clear here that one can not only obtain a plurality of different edits in the offspring of an event that has an FMOS promoter driving the targeted nuclease, but that some offspring will have edits in one gene while others will have edits in both genes.

TABLE 45

The T1 genotyping information from construct 25053. Offspring of construct 25053 were sampled for Taqman assay and then PCR-sequenced to find the diverse editing patterns (sequencing results showing the variants produced).

| | WHP1 Taqman Assay (gRNA1) | WHP1 Variant (sequencing result) | C2 Taqman Assay (gRNA1) | C2 Variants (sequencing result) | WHP1 Taqman Assay (gRNA2) | C2 Taqman Assay (gRNA2) |
|---|---|---|---|---|---|---|
| GVG01194901-44 | 2 | WT | 1 | 50% 580-581bp: 1bp (C) insertion | 2 | 2 |
| GVG01194901-77 | 1 | 50% 3527-3528bp: 1bp (T) insertion | 2 | WT | 2 | >2 |
| GVG01194901-91 | 2 | | 1 | 50% 575-598bp, 24bp deletion | 2 | 2 |
| GVG01194902-112 | 1 | 50% 3527bp (C) deletion | 2 | | >2 | 2 |
| GVG01194902-122 | 1 | 50% 3527bp (C) deletion | 2 | | 2 | 2 |
| GVG01194902-131 | >2 | | 1 | 50% 568-587bp, 20bp deletion | 2 | 2 |
| GVG01194902-24 | 1 or 2 | | 1 | 50% 570-583bp, 14bp deletion | 1 or 2 | 2 |
| GVG01194902-67 | 2 | | 1 | 50% 581bp (C) deletion | 2 | 2 |
| GVG01194902-98 | 1 | 50% 3527-3529bp (CTT) deletion | 1 or 2 | | >2 | 2 |
| GVG01194908-1 | >2 | | 1 | 50% 581bp (C) deletion | 2 | 2 |
| GVG01194908-25 | 2 | | 1 | 50% 581bp (C) deletion | >2 | 2 |
| GVG01194908-33 | 1 | 50% 3516-3529bp, 14bp deletion | 2 | | 2 | 2 |
| GVG01194908-4 | 2 | | 1 | 50% 581bp (C) deletion | 2 | 2 |
| GVG01194908-45 | 1 | 50% 3527-3528bp: 1bp (A) insertion | 1 | 50% 581bp (C) deletion | 2 | 2 |
| GVG01194908-51 | 2 | | 1 | 50% 581bp (C) deletion | >2 | 2 |
| GVG01194908-87 | 1 | 50% 3514-3533bp, 20bp deletion | 2 | | 2 | 2 |
| GVG01194912-107 | 1 | 50% 3527bp (C) deletion | 2 | | 1 or 2 | 2 |
| GVG01194912-114 | 1 | 50% 3524-3527bp, 4bp deletion | 2 | | 2 | 2 |
| GVG01194912-25 | 2 | | 1 | 28% 582bp T-->C mutation | 2 | >2 |
| GVG01194912-61 | 1 | 50% 3527bp (C) deletion | 2 | | >2 | 1 or 2 |
| GVG01194912-90 | 1 | 50% 3527-3528bp: 1bp (T) insertion | 2 | | 2 | >2 |

Exemplary Embodiments

1. A method for creating variable knock-out combinations in a gene regulatory network (GRN) having at least a first DNA encoding a first network member and a second DNA encoding a second network member, the method comprising:

a) transforming at least one expression cassette into a plant cell or a plant tissue, wherein the at least one expression cassette comprises a nucleic acid that encodes a DNA modification enzyme, a nucleic acid that encodes a first guide RNA (gRNA) targeting the first DNA encoding the first network member, a nucleic acid that encodes a second guide RNA (gRNA) targeting the second DNA encoding the second network member, and a floral mosaic (FMOS) regulatory sequence, wherein the FMOS regulatory sequence (i) mediates expression of the DNA modification enzyme in at least one of a floral primordia cell and a floral reproductive organ, and (ii) mediates a plurality of edits in the at least one of the floral primordia and the floral reproductive organ; and b) regenerating the plant cell or plant tissue into a T0 plant having a plurality of T1 seed, wherein the T1 seed contain a plurality of unique knock-out combinations in the GRN.

2. The method of claim 1, further comprising
   selfing one of the plurality of T1 seed having a unique knock-out combination to make a T2 mutant plant that is homozygous for the unique knock-out combination; and
   selfing another of the plurality of T1 seed having a unique knock-out combination to make a different T2 mutant plant that is homozygous for a different unique knock-out combination.
3. The method of any of the above, wherein the DNA modification enzyme is a site-directed nuclease selected from the group consisting of a Cas9 nuclease, a Cpf1 nuclease, a dCas9-FokI, a dCpf1-FokI, a chimeric Cas9-cytidine deaminase, a chimeric Cas9-adenine deaminase, a chimeric FEN1-FokI, and a MegaTALs, a nickase Cas9 (nCas9), a chimeric dCas9 non-FokI nuclease and a dCpf1 non-FokI nuclease.
4. The method of any of the above, wherein the DNA modification enzyme is a Cas9 nuclease or a Cpf1 nuclease.
5. The method of any of the above, further comprising
   growing the T1 seed to produce a plurality of T1 plants, and
   measuring at least one phenotype in plants of the T1 generation, and
   selecting a plant of the T1 generation based on the measuring of at least one phenotype, wherein the selected plant has a unique phenotype.
6. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
7. The method of any of the above, wherein the FMOS regulatory sequence mediates expression of more DNA modification enzyme in the floral primordia and the floral reproductive organ (rates are similar to those previously described herein), and more expression of the DNA modification enzyme in the floral primordia and the floral reproductive organ than in a seed (rates are similar to those previously described herein).
8. The method of any of the above, wherein the FMOS regulatory sequence comprises an FMOS promotor and an FMOS terminator.
9. The FMOS promoter and terminator may be any of those disclosed herein.
11. The method of any of the above, wherein the plurality of unique knock-out combination includes at least one of: at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique combinations.
12. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.
13. The method of any of the above, wherein FMOS regulatory sequence
   (i) mediates expression of the DNA modification enzyme in both a male and a female floral reproductive organ, and
   (ii) mediates a plurality of edits in both a male and a female floral reproductive organ.
14. The method of any of the above, wherein the FMOS regulatory sequence mediates more expression of the DNA modification enzyme in the floral primordia and the floral reproductive organ than in vegetative tissue, and wherein the FMOS regulatory sequence mediates more expression of the DNA modification enzyme in the floral primordia and the floral reproductive organ than in a seed (with relative amounts, e.g. at least 2× more, at least 3× more, being the same as described for other embodiments).
15. The method of any of the above, wherein the T0 plant has a mosaicism score of at least 0.5, 1, 1.5, 2, 3, 4, 5, 6, 7, 8, 9, 10, 11, 12, 13, 14, 15, 16 17, 18, 19, and 20, wherein the mosaicism score is determined by Mosaicism Score Methodology 1. The upper limit of the mosaicism score will be determined by the efficacy of the FMOS promoter, however, applicant expects typical mosaicism scores to be in the range of at least one of 0.5 to 30, 1 to 25, 2 to 25, 3 to 25, 4 to 25, 5 to 25, 6 to 25, 5 to 20, 5 to 19, 5 to 18, 5 to 17, 5 to 16, and 5 to 15.
16. At least one expression cassette including any combination of the components described in 1-15 above.
17. A plant produced by the method of 1-15.
18. A plant cell containing the at least one expression cassette of 16.

Example 12: Partnering FMOS with Targeted Saturated Mutagenesis, e.g. CRISPR-X or EvolvR In some embodiments, the disclosure provides methods and compositions that improve upon existing saturated mutagenesis technologies. For example, embodiments of the invention provide unexpected benefits when paired with targeted saturated mutagenesis technologies, for example, CRISPR-X or EvolvR technologies. CRISPR-X refers to dCas9 linked to a hyperactive AID (cytidine deaminase), which can generate targeted (and semi-random) point mutations (as used herein a "point mutation" refers to the replacement of a single nucleotide with a different nucleotide). For more discussion of CRISPR-X technology, see United States Patent Application Publication 2019309288A, the entire contents of which are incorporated by reference herein. EvolvR is nCas9 linked to an error-prone DNA polymerase as described in Halperin, S. O., Tou, C. J., Wong, E. B. et al. CRISPR-guided DNA polymerases enable diversification of all nucleotides in a tunable window. Nature 560, 248-252 (2018). Novel genetic variation can be achieved by employing CRISPR-X or by using EvolvR. These new technologies are workable with ubiquitous promoters, but applicant believes that only a fairly limited range of mutations may be made in each generation or in each plant due to the lack of mosaicism and early editing. Furthermore, applicant believes existing systems may have negative fitness implications to the plant in some situations. Accordingly, in some embodiments of the instant disclosure, applicant makes significant improvements to existing echnologies using, inter alia, FMOS promoters, to generate an extraordinarily large diversity of outcomes in the distinct germinal lineages of flowers that will be differentially inherited in the progeny seeds.

According to some embodiments of the invention, plants are produced by stable transformation of a construct containing an FMOS promoter driving expression of a deactivated or nickase CRISPR (dCas9, nCas9, dCas12a, or another non-double stranded DNA cutting nuclease) that contains an N-terminally fused (or C-terminally fused) hyperactive cytidine deaminase (AID). In another cassette or another part of the construct, one or multiple targeting guideRNAs are expressed, either constitutively or utilizing an FMOS promoter. Editing by the fusion enzyme thus occurs in the T0 event's flowers such that a plurality of distinct base edited alleles can be recovered in the offspring. Those based edited alleles are then analyzed by sequencing or, optionally, the offspring are screened phenotypically to identify a variant that performs at a desired level for a particular trait of interest (optionally, the plants that meet the phenotypic threshold are then sequenced to discover which base edit mutation produced that favorable result). In another typical embodiment the nuclease and guide RNAs, which contain MS2 RNA hairpins are expressed using a highly expressed constitutive or ubiquitous promoter and the FMOS promoter is used to express the AID linked to an MS2 domain. As before, the diverse base-editing will then occur in flowers and a diversity of distinct edits can be recovered in the offspring.

In some embodiments, plants are produced by stable transformation of at least one expression cassette comprising an FMOS promoter driving expression of a nickase CRISPR (nCas9, nCas12a or another nicking enzyme) that contains an N-terminally fused (or C-terminally fused) error prone DNA polymerase such as DNA polI3M. In the at least one cassette or another part of the construct one or multiple targeting guideRNAs are expressed, either constitutively or utilizing an FMOS promoter. Editing by the fusion enzyme thus occurs in the T0 event's flowers such that a plurality of distinct base edited alleles can be recovered in the offspring. Those based edited alleles are then analyzed by sequencing or, optionally, the offspring are screened phenotypically to identify a variant that performs at a desired level for a particular trait of interest (optionally, the plants that meet the phenotypic threshold are then sequenced to discover which base edit mutation produced that favorable result). In another typical embodiment the nuclease and guide RNAs, which contain MS2 RNA hairpins are expressed using a highly expressed constitutive or ubiquitous promoter and the FMOS promoter is used to express the error-prone DNA polymerase to an MS2 domain. As before, the diverse base-editing will then occur in flowers and a diversity of distinct edits can be recovered in the offspring.

SEQ ID NO: 612 is a nucleotide sequence for Vector Cr-X-FMOS, which is one example of a vector containing at least one expression cassette comprising a nCas, and which can be used to create a plurality of unique point mutations according to embodiments of the invention.

| Vector Cr-X-FMOS (SEQ ID NO: 612) | Position by bp | Name |
|---|---|---|
| Right border region of T-DNA of *Agrobacterium tumefaciens* nopaline ti-plasmid. Differs from bNRB-03 by 20 bp at 5' end. | 4-143 | bNRB-04 |
| 40 bp site for plant insert intactness testing and to stop readthrough ORFs. Typically by agro RB. 1 bp different than -01. | 144-183 | xTAG-06 |
| 6-frame stop to minimize unintended ORF read-through | 184-195 | xSTOPS-01 |
| The promoter of maize Bearded Ear1 gene (Zm00001d017614) from B73v5 for specific expression in early inflorescence meristems. The sequence includes upstream promoter, first exon, first intron, and second exon (partial), with two bp changes to remove ATG start codon and to remove one BbsI site for cloning. Additionally, this version has an extended sequence at 5' end. | 227-5964 | prZmBde1-02 |
| first intron of maize Bearded Ear1 gene (Zm00001d017614) from B73v5 | 2618-5949 | iZmBde1-01 |
| Coding sequence of *Streptococcus pyogenes* Cas9 gene with introduced D10A mutation to turn it to a nickase, which was codon optimized for corn expression as in cCas9-01. | 5981-10150 | cCas9-15 (nCas9) |
| SV40 nuclear locating signal peptide, used to drive protein into nucleus. | 10085-10147 | XSV40NLS-03 |
| A 9 amino acid epitope tag identical to that of the GP64 envelope fusion protein (GP64 EFP) from baculovirus (Antheraea pernyi nucleopolyhedrovirus). | 10115-10141 | xEpitope-01 |
| The terminator sequence of maize Bearded Ear1 gene (Zm00001d017614) from B73v5. | 10155-11306 | tZmBde1-01 |
| Cestrum Yellow leaf curl virus promoter & leader (start aagggagc?). genbank AF364175. US20040086447. prCMP-01 with 1 base pair truncation on 5' end and 2 base pair truncation on 3' end | 11314-11710 | prCMP-04 |
| Maize optimized coding sequence of an activation-induced cytidine deaminase (AID) with MS2 tag fused at N-terminal. MS2 is a bacteriophage capsid RNA-binding protein and is used to tether MS2 loop - containing CRISPR guide RNAs. In addition, it also includes a 60 bp partial T2A linker sequence at C-terminal derived from the insect Thosea asigna virus (T2A) to be consistant with the design in the original publication. | 11719-12852 | cMS2AID-01 |
| aize expression optimzed coding sequence region of MS2 bacteriophage capsid RNA-binding protein, recognizing with high specificity and affinity for the hairpin loop structure formed by a 19-nucleotide long viral (bacteriophage) RNA sequence present at the ribosomal binding site of the MS2 replicase mRNA. MS2 has been used widely to tag RNA transcribed in vitro and in vivo for other application. | 11719-12162 | xMS2 |
| SV40 nuclear locating signal peptide, used to drive protein into nucleus. | 12163-12182 | XSV40NLS |
| Maize expression optimized coding sequence region of an activation-induced cytidine deaminase (AID), which deaminates a cytosine (C) to a uracil (U), cotaining mutations of K10E + T82I + E156G and removing Nuclear export signal LGL at C-terminal to make it hyperactive. | 12199-12783 | xAID-01 |

| Vector Cr-X-FMOS (SEQ ID NO: 612) | Position by bp | Name |
|---|---|---|
| The maize optimized T2A sequence encoding the remaining 20aa after the self cleavaging between last two amino acids G and P; a full T2A sequence of Thoseaasigna virus encodes a peptide of (GAG) E G R G S L L T C G D V E E N P G P. | 12799-12849 | xT2A |
| synthetic Nopaline synthetase terminator | 12853-13105 | tNOS-05-01 |
| Rice U3 promoterfor pol III dependent transcription of non-coding RNAs | 13112-13486 | prOsU3-01 |
| The MS2 hairpin-loop embedded basic scaffold of single guide RNA (sgRNA) in which the target sequence at the 5' end is removed; composed of xcrRNA (CRISPR RNA portion) from *Streptococcus pyogenes*, xtracrRNA (trans-activating crRNA portion) from *Streptococcus pyogenes*, two copies of 19-nucleotide long viral (bacteriophage) RNA sequence present at the ribosomal binding site of the MS2 replicase mRNA, and a polyU terminator from Arabidopsis thaliana. | 13494-13656 | rsgRNA2xMS2ZmAdh1-01 |
| Protospacer sequence for ZmAdh1 gene. | 13494-13513 | ZmAdh1target |
| A piece of crRNA (CRISPR RNA) from *Streptococcus pyogenes* CRISPR system, without target sequence, truncated at +12. It is used in conjunction with tracrRNA (trans-activating crRNA) to make the chimeric single guide RNA (sgRNA). | 13514-13525 | rCrRNA-01 |
| The MS2 hairpin-loop embedded basic scaffold of single guide RNA (sgRNA) in which the target sequence at the 5' end is removed; composed of xcrRNA (CRISPR RNA portion) from *Streptococcus pyogenes*, xtracrRNA (trans-activating crRNA portion) from *Streptococcus pyogenes*, two copies of 19-nucleotide long viral (bacteriophage) RNA sequence present at the ribosomal binding site of the MS2 replicase mRNA, and a polyU terminator from Arabidopsis thaliana. | 13514-13656 | rsgRNA2xMS2base-01 |
| stem loop that binds the bacteriophage MS2 coat | 13531-13549 | xMS2 stem loop |
| gRNA scaffold of CRISPR/Cas9 system | 13560-13596 | rTracrRNA Frag1 |
| stem loop that binds the bacteriophage MS2 coat | 13601-13619 | xMS2 stem loop |
| gRNA scaffold of CRISPR/Cas9 system | 13630-13649 | rTracrRNA frag2 |
| prUbi1-10 with T to C at nt597, G to A at nt1047, C to T at nt1117 | 13683-15675 | prUbi1-18 |
| iUbi1-02-01 with G to A at nt61 and C to T at nt134 | 14666-15675 | iUbi1-07 |
| *E. coli* manA gene encoding phosphomannose isomerase | 15688-16863 | cPMI-01 |
| The terminator from the UBI1 gene from *Zea mays*. optimized to remove internal SbfI site | 16902-17936 | tUbi1-04 |
| 6-frame stop to minimize unintended ORF read-through | 17959-17970 | xSTOPS-01 |
| 40 bp site for plant insert intactness testing and to stop readthrough ORFs. Typically by agro LB. | 17971-18010 | xTAG-02 |
| Left border region of T-DNA of *Agrobacterium tumefaciens* nopaline ti-plasmid. Differs from bNLB-03 by one base pair to remove ATG start codon for ORF pointing into flanking region. | 18019-18148 | bNLB-05 |
| Also called aadA; gene encoding the enzyme aminoglycoside 3'adenyltransferase that confers resistance to spectinomycin and streptomycin for maintenance of the vector in *E. coli* and *Agrobacterium*. aka cSPEC-03 | 18428-19216 | cSpec-03 |
| virG promoter (Winans J. Bact. 172: 2433-38 (1990)) composed of two promoter elements, one responsive to acetosyringone and phosphate-starvation (bp 45 to 83) and another to medium acidification (86 to 128) | 19311-19441 | prVirG-01 |
| virG (putative) from pAD1289 with TTG start codon. virGN54D came from pAD1289 described in Hansen et al. 1994, PNAS 91: 7603-7607 | 19516-20241 | cVirG-01 |
| cRepA-01 with A to G at nt735 | 20271-21344 | cRepA-03 |
| origin of replication and partitioning region from plasmid pVS1 of Pseudomonas (Itoh et al. 1984, Plasmid 11: 206-220); similar to GenBank Accession Number U10487; serves as origin of replication in Agrobacterium tumefaciens host | 21387-21791 | oVS1-02 |
| The ColE1 origin of replication functional in *E. coli* derived from pUC19 | 22469-23275 | oCOLE-06 |

SEQ ID NO: 613 is a nucleotide sequence for Vector Ev-FMOS, which is another example of a vector containing at least one expression cassette comprising a nCas, and which can be used to create a plurality of unique point mutations according to embodiments of the invention.

| Vector Ev-FMOS (SEQ ID NO: 613) | Position by bp | Name |
|---|---|---|
| Right border region of T-DNA of *Agrobacterium tumefaciens* nopaline ti-plasmid. Differs from bNRB-03 by 20 bp at 5' end. | 4-143 | bNRB-04 |

-continued

| Vector Ev-FMOS (SEQ ID NO: 613) | Position by bp | Name |
|---|---|---|
| The promoter of maize Bearded Ear1 gene (Zm00001d017614) from B73v5 for specific expression in early inflorescence meristems. The sequence includes upstream promoter, first exon, first intron, and second exon (partial), with two bp changes to remove ATG start codon and to remove one Bbsl site for cloning. Additionally, this version has an extended sequence at 5' end. | 227-5964 | prZmBde1-02 |
| first intron of maize Bearded Ear1 gene (Zm00001d017614) from B73v5 | 2618-5949 | iZmBde1-01 |
| A rice codon optimized sequence encoding a nuclear location signal PKKKRKV as found in Small Nuclear RNA Activating Complex subunit SNAP43 of Oikopleura dioica. This core nuclear localization signal sequence is highly conserved across multiple Kingdoms. | 5973-5999 | xNLS-03 |
| A rice codon optimized sequence encoding GIHGVPA as found in nuclear-pore anchor isoform XI of Prunus persica; believed to function as an epitope tag. | 6000-6023 | xEpitope-03 |
| Fused protein includes D10A nCas9 plus three mutations (K848A, K1003A, R1060A) to lower the nonspecific DNA affinity of Cas9 and fidelity-reduced variant of Escherichia coli DNA polymerase I (PolI) with corn codon optimization harbouring the mutations D424A, I709N and A759R (PolI3M). This fusion protein was expected to generate diversification in defined regions of a genome. | 5973-13043 | cCas9-19 (nCas9) |
| fidelity-reduced variant of Escherichia coli DNA polymerase I (PolI) with corn codon optimization harbouring the mutations D424A, I709N and A759R (PolI3M) | 10260-13040 | xPolI3M |
| The terminator sequence of maize Bearded Ear1 gene (Zm00001d017614) from B73v5. | 13050-14201 | tZmBde1-01 |
| Rice U3 promoterfor pol III dependent transcription of non-coding RNAs | 14213-14587 | prOsU3-01 |
| Single guide RNA targeting the ADH1 gene (Alcohol dehydrogenase, corresponding to GRMZM2G442658 in B73 genome) in JHAX genome at sequence cggcaagccactgtcgatcg on exon2 labeled as ZmADH1target. | 14588-14693 | rsgRNAZmADH1-01 |
| Protospacer sequence for ZmAdh1 gene. | 14589-14608 | ZmADH1target |
| A piece of crRNA (CRISPR RNA) from Streptococcus pyogenes CRISPR system, without target sequence, truncated at +12. It is used in conjunction with tracrRNA (trans-activating crRNA) to make the chimeric single guide RNA (sgRNA). | 14609-14620 | rCrRNA-01 |
| A truncated form of tracrRNA (trans-activating crRNA) from Streptococcus pyogenes CRISPR system. It is used in conjunction with crRNA (CRISPR RNA) to make the chimeric sgRNA (single guide RNA). Contains poly T region from Streptococcus pyogenes, with one additional T added during synthesis. | 14625-14693 | rTracrRNA-01 |
| prUbi1-10 with T to C at nt597, G to A at nt1047, C to T at nt1117 | 14720-16712 | prUbi1-18 |
| iUbi1-02-01 with G to A at nt61 and C to T at nt134 | 15703-16712 | iUbi1-07 |
| E. coli manA gene encoding phosphomannose isomerase | 16725-17900 | cPMI-01 |
| The terminator from the UBI1 gene from Zea mays. optimized to remove internal Sbfl site | 17939-18973 | tUbi1-04 |
| 6-frame stop to minimize unintended ORF read-through | 18996-19007 | xSTOPS-01 |
| 40 bp site for plant insert intactness testing and to stop readthrough ORFs. Typically by agro LB. | 19008-19047 | xTAG-02 |
| Left border region of T-DNA of Agrobacterium tumefaciens nopaline ti-plasmid. Differs from bNLB-03 by one base pair to remove ATG start codon for ORF pointing into flanking region. | 19056-19185 | bNLB-05 |
| Also called aadA; gene encoding the enzyme aminoglycoside 3'adenyltransferase that confers resistance to spectinomycin and streptomycin for maintenance of the vector in E. coli and Agrobacterium, aka cSPEC-03 | 19465-20253 | cSpec-03 |
| virG promoter (Winans J. Bact. 172: 2433-38 (1990)) composed of two promoter elements, one responsive to acetosyringone and phosphate-starvation (bp 45 to 83) and another to medium acidification (86 to 128) | 20348-20478 | prVirG-01 |
| virG (putative) from pAD1289 with TTG start codon. virGN54D came from pAD1289 described in Hansen et al. 1994, PNAS 91: 7603-7607 | 20553-21278 | cVirG-01 |
| cRepA-01 with A to G at nt735 | 21308-22381 | cRepA-03 |
| origin of replication and partitioning region from plasmid pVS1 of Pseudomonas (Itoh et al. 1984, Plasmid 11: 206-220); similar to GenBank Accession Number U10487; serves as origin of replication in Agrobacterium tumefaciens host | 22424-22828 | oVS1-02 |
| The ColE1 origin of replication functional in E. coli derived from pUC19 | 23506-24312 | oCOLE-06 |

Exemplary Embodiments with dCas

1. A method for producing a plurality of unique point mutations in a plant's T1 seed, the method comprising:
   a) transforming at least one expression cassette into a plant cell or a plant tissue, wherein the at least one expression cassette comprises
      a nucleic acid that encodes a catalytically dead Cas (dCas),
      a nucleic acid that encodes at least one guide RNA (gRNA) bearing an MS2 hairpin binding site,
   a nucleic acid that encodes a deaminase, and
   a floral mosaic (FMOS) regulatory sequence, wherein the FMOS regulatory sequence
   (i) mediates expression of the DNA modification enzyme in at least one of a floral primordia cell and a floral reproductive organ, and
   (ii) mediates a plurality of edits in the at least one of the floral primordia and the floral reproductive organ; and
   b) regenerating the plant cell or plant tissue into a T0 plant having a plurality of T1 seed, wherein the T1 seed contain a plurality of unique point mutations.
2. The method of 1, wherein the catalytically dead Cas (dCas) is a catalytically dead Cas9 (dCas9) or a dead Cas 12a (dCas12a).
3. The method of any of the above, wherein the deaminase is an activation induced cytidine deaminase (AID).
4. The method of any of the above, wherein the nucleic acid that encodes a gRNA is operably linked to the FMOS promoter or a second promoter.
5. The method of any of the above, further comprising growing the T1 seed to produce a plurality of T1 plants, and
measuring at least one phenotype in plants of the T1 generation, and
selecting a plant of the T1 generation based on the measuring of at least one phenotype, wherein the selected plant has a plurality of unique point mutations.
6. The method of 5, further comprising crossing the selected plant of the T1 generation having a unique edit with a plant not having the unique edit to produce a progeny having the unique edit.
7. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
8. The method of any of the above, wherein the FMOS regulatory sequence mediates expression of more DNA modification enzyme in the floral primordia and the floral reproductive organ (rates are similar to those previously described herein), and more expression of the DNA modification enzyme in the floral primordia and the floral reproductive organ than in a seed (rates are similar to those previously described herein).
9. The method of any of the above, wherein the FMOS regulatory sequence comprises an FMOS promotor and an FMOS terminator.
10. The FMOS promoter and terminator may be any of those disclosed herein.
11. The method of any of the above, wherein the plurality of unique point mutations includes at least one of: at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 point mutations.
12. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.
13. The method of any of the above, wherein FMOS regulatory sequence
   (i) mediates expression of the DNA modification enzyme in both a male and a female floral reproductive organ, and
   (ii) mediates a plurality of unique point mutations in both a male and a female floral reproductive organ.
14. The method of any of the above, wherein the T0 plant has a mosaicism score of at least 0.5, 1, 1.5, 2, 3, 4, 5, 6, 7, 8, 9, 10, 11, 12, 13, 14, 15, 16 17, 18, 19, and 20, wherein the mosaicism score is determined by Mosaicism Score Methodology 1. The upper limit of the mosaicism score will be determined by the efficacy of the FMOS promoter, however, applicant expects typical mosaicism scores to be in the range of at least one of 0.5 to 30, 1 to 25, 2 to 25, 3 to 25, 4 to 25, 5 to 25, 6 to 25, 5 to 20, 5 to 19, 5 to 18, 5 to 17, 5 to 16, and 5 to 15.
15. At least one expression cassette including any combination of components described in 1-14.
16. A plant produced by a method of 1-14.
16. A plant cell comprising at least one expression cassette of 15.

Exemplary Embodiments with CRISPR-Guided DNA Polymerase

1. A method for producing a plurality of unique point mutations in a plant's T1 seed, the method comprising:
   a) transforming at least one expression cassette into a plant cell or a plant tissue, wherein the at least one expression cassette comprises
      a nucleic acid that encodes a nicking variant of Cas (nCas),
      a nucleic acid that encodes a DNA polymerase (Pol),
      a nucleic acid that encodes at least one guide RNA (gRNA), and
      a floral mosaic (FMOS) regulatory sequence, wherein the FMOS regulatory sequence
         (i) mediates expression of the nCas and the Pol in at least one of a floral primordia cell and a floral reproductive organ, and
         (ii) mediates a plurality of edits in the at least one of the floral primordia and the floral reproductive organ; and
   b) regenerating the plant cell or plant tissue into a T0 plant having a plurality of T1 seed, wherein the T1 seed contain a plurality of unique point mutations.
2. The method of 1, wherein the nCas is a nicking Cas9 (nCas9) or a nicking Cas 12a (nCas12a).
3. The method of 2, wherein the nCas is a nCas9 having a D10A mutation.
4. The method of any of the above, wherein the encoded nCas is fused to the encoded Pol.
5. The method of any of the above, wherein the Pol is an *E. coli* PolI.
6. The method of any of the above, wherein the Pol includes at least one of the following mutations D424A, I709N and A759R.

7. The method of any of the above, wherein the nucleic acid that encodes a gRNA is operably linked to the FMOS promoter or a second promoter.
8. The method of any of the above, further comprising growing the T1 seed to produce a plurality of T1 plants, and measuring at least one phenotype in plants of the T1 generation, and selecting a plant of the T1 generation based on the measuring of at least one phenotype, wherein the selected plant has a plurality of unique point mutations.
9. The method of 8, further comprising
sequencing the insertion site of the Donor DNA in the selected plant of the T1 generation,
sequencing the insertion site of the Donor DNA of a non-selected plant of the T1 generation, and
aligning the insertion site sequence of the selected plant with the insertion site sequence of the non-selected plant.
10. The method of 9, further comprising crossing the selected plant of the T1 generation having a unique edit with a plant not having the unique edit to produce a progeny having the unique edit.
11. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
12. The method of any of the above, wherein the FMOS regulatory sequence mediates expression of more DNA modification enzyme in the floral primordia and the floral reproductive organ (rates are similar to those previously described herein), and more expression of the DNA modification enzyme in the floral primordia and the floral reproductive organ than in a seed (rates are similar to those previously described herein).
13. The method of any of the above, wherein the FMOS regulatory sequence comprises an FMOS promotor and an FMOS terminator.
14. The FMOS promoter and terminator may be any of those disclosed herein.
15. The method of any of the above, wherein the plurality of unique point mutations includes at least one of: at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 point mutations.
16. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.
17. The method of any of the above, wherein FMOS regulatory sequence
(i) mediates expression of the DNA modification enzyme in both a male and a female floral reproductive organ, and
(ii) mediates a plurality of unique point mutations in both a male and a female floral reproductive organ.
18. The method of any of the above, wherein the T0 plant has a mosaicism score of at least 0.5, 1, 1.5, 2, 3, 4, 5, 6, 7, 8, 9, 10, 11, 12, 13, 14, 15, 16 17, 18, 19, and 20, wherein the mosaicism score is determined by Mosaicism Score Methodology 1. The upper limit of the mosaicism score will be determined by the efficacy of the FMOS promoter, however, applicant expects typical mosaicism scores to be in the range of at least one of 0.5 to 30, 1 to 25, 2 to 25, 3 to 25, 4 to 25, 5 to 25, 6 to 25, 5 to 20, 5 to 19, 5 to 18, 5 to 17, 5 to 16, and 5 to 15.
19. At least one expression cassette including any combination of components described in 1-18.
20. A plant produced by a method of 1-17.
21. A plant cell comprising at least one expression cassette of 19.

Example 13: Large Deletions with FMOS Promoters

In some embodiments, the disclosure provides methods and compositions for generating large deletions in plant genomes, including genic regions, recombination hot spots, recombination cold spots, inverted regions, centromeres, telomeres, knobs, and other regions. Generally, the extremely low efficiency of generating large deletions makes these experimental goals very difficult without an enormous investment in generating a large population of events. By using an FMOS promoter, large deletions are much more readily achievable with just a small investment to make a few events. With some embodiments, there further exists the potential to delete whole chromosomal regions, or even whole chromosome arms.

In one example, two guide RNAs that are about 1 Mb (one million base pairs) apart are designed to delete a large intergenic region in maize. These two guide RNAs are installed in a binary vector with Cas9 driven by an FMOS promoter and a selectable marker (PMI). Due to the low efficiency of having two guide RNAs cut simultaneously to generate a deletion, and due to the fact that with increasing distance between the two target sites, the lower the efficiency of generating a deletion, the likelihood of deleting 1 Mb of sequence is extremely low. Using a constitutive promoter, it would normally require about 5000 events to achieve this large deletion. With FMOS promoters, it is achieved by screening 5000progeny from ten events, which overall significantly reduced the time and labor and cost of making that deletion. From those 5000 plants, one is identified which has the desired deletion. This is detected by running PCR using two primers that flank the 1 Mb region (a forward primer that is designed upstream of the upstream guide RNA target, and a reverse primer that is designed downstream of the downstream guide RNA target). This PCR assay is only positive in one out of the 5000 plants, or false-positive PCR amplicons are further revealed to be errors. Upon further sequencing of the PCR product, it is found that the sequence is just as predicted—the 1 Mb intergenic region is deleted. This intergenic region contained no genes but a lot of transposons and repetitive DNA. No plant phenotypes were observed that distinguished the edited plants with the large deletion from unedited plants. In another embodiment, the deleted region contains several genes that have a deleterious effect on the plant growth or development. In another embodiment, the deleted region contains a knob which drives aberrant reproductive phenotypes, the removal of which streamlines the breeding process. In another embodiment, numerous guide RNAs tiled throughout a genomic region are used to create a series of small and large deletions.

In another embodiment, guide RNAs that span an entire chromosome or chromosome arm are used to induce full deletion of that arm or that chromosome. Within this embodiment, the construct is transformed into an inbred, hybrid, inter- or intra-specific hybrid, or derivative line of these that has supernumerary chromosomes or unwanted chromosome segments that may be deleted.

In another embodiment, instead of using a Cas9 nuclease and multiple guide RNAs, an allelic series is created through deletions of very large regions through the use of the Cas3 nuclease complex (replacing Cas9 in the vector) driven by the FMOS promoter.

Exemplary Embodiments for Deleting Large Intergenic Regions

1. A method for deleting a large intergenic region in a plant's T1 seed, the method comprising:
a) transforming at least one expression cassette into a plant cell or a plant tissue, wherein the at least one expression cassette comprises
a nucleic acid that encodes a RNA site-directed nuclease,
a nucleic acid that encodes at least one first guide RNA (gRNA-1)
a nucleic acid that encodes at least one second guide RNA (gRNA-2), wherein the gRNA-1 targets a first target sequence on a chromosome and wherein the gRNA-2 targets a second target sequence on the chromosome, wherein the first target sequence and the second target sequence are at least 0.1 Mb apart, and
a floral mosaic (FMOS) regulatory sequence, wherein the FMOS regulatory sequence
(i) mediates expression of the DNA modification enzyme in at least one of a floral primordia cell and a floral reproductive organ, and
(ii) mediates a plurality of edits in the at least one of the floral primordia and the floral reproductive organ; and
b) regenerating the plant cell or plant tissue into a T0 plant having a plurality of T1 seed, wherein the T1 seed contain at least one large intergenic deletion.
2. The method of 1, wherein the large intergenic region includes at least one region in the range of at least one of 0.1-2 Mb, 0.2-1.9 Mb, 0.3-1.8 Mb, 0.4-1.7 Mb, 0.5-1.6 Mb, 0.6-1.5 Mb, 0.7-1.4 Mb, 0.7-1.3 Mb, 0.7-1.2 Mb, 0.3-1.1 Mb, 0.3-1.0 Mb, 0.4-1.0 Mb, 0.5-1.0 Mb, and 0.6-0.8 Mb.
3. The method of any of the above, wherein the first target sequence and the second target sequence are separated by at least one distance in the range of at least one of 0.1-2 Mb, 0.2-1.9 Mb, 0.3-1.8 Mb, 0.4-1.7 Mb, 0.5-1.6 Mb, 0.6-1.5 Mb, 0.7-1.4 Mb, 0.7-1.3 Mb, 0.7-1.2 Mb, 0.3-1.1 Mb, 0.3-1.0 Mb, 0.4-1.0 Mb, 0.5-1.0 Mb, and 0.6-0.8 Mb.
4. The method of any of the above, wherein the site-directed nuclease is a Cas nuclease.
5. The method of any of the above, wherein
wherein the nucleic acid that encodes a gRNA-1 is operably linked to the FMOS promoter or a second promoter, and
wherein the nucleic acid that encodes a gRNA-2 is operably linked to the FMOS promoter, to the second promoter, or to a third promoter.
5. The method of any of the above, further comprising growing the T1 seed to produce a plurality of T1 plants, and
measuring at least one phenotype in plants of the T1 generation, and
selecting a plant of the T1 generation based on the measuring of at least one phenotype, wherein the selected plant has a large intergenic deletion.
6. The method of 5, further comprising
sequencing the insertion site of the Donor DNA in the selected plant of the T1 generation,
sequencing the insertion site of the Donor DNA of a non-selected plant of the T1 generation, and
aligning the insertion site sequence of the selected plant with the insertion site sequence of the non-selected plant.
7. The method of 6, further comprising crossing the selected plant of the T1 generation having the large intergenic deletion with a plant not having the a large intergenic deletion to produce a progeny having the a large intergenic deletion.
8. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
9. The method of any of the above, wherein the FMOS regulatory sequence mediates expression of more DNA modification enzyme in the floral primordia and the floral reproductive organ (rates are similar to those previously described herein), and more expression of the DNA modification enzyme in the floral primordia and the floral reproductive organ than in a seed (rates are similar to those previously described herein).
10. The method of 1, wherein the FMOS regulatory sequence comprises an FMOS promoter and an FMOS terminator.
11. The FMOS promoter and terminator may be any of those disclosed herein.
12. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.
13. At least one expression cassette including any combination of components described in 1-12.
14. A plant produced using a method as described in 1-12 above.
15. A plant cell containing at least one expression cassette of 13.

Example 14: Inducing guideRNA Expression in Flowers Using FMOS Promoters

Various changes may be made within the scope of the current invention. For example, in some embodiments, instead of using an FMOS promoter to drive Cas9, one could achieve the same result by using an FMOS promoter to drive the expression of guideRNAs, and simply have Cas under control of a constitutive promoter.

Exemplary Embodiments

1. A method for producing a plurality of unique edits in a plant's T1 seed, the method comprising:
a) transforming at least one expression cassette into a plant cell or a plant tissue, wherein the at least one expression cassette comprises
a nucleic acid that encodes a RNA site-directed nuclease,
a nucleic acid that encodes a guide RNA (gRNA), and
a floral mosaic (FMOS) regulatory sequence comprising an FMOS promoter, wherein the FMOS regulatory sequence
(i) mediates expression of the gRNA in at least one of a floral primordia cell and a floral reproductive organ,
(ii) mediates a plurality of edits in the at least one of the floral primordia and the floral reproductive organ,
(iii) mediates at least one of at least two-fold more expression, at least three-fold more expression, at least four fold-more expression, at least 5-fold more expression and at least six-fold more expression of the gRNA in the at least one of the floral primordia and the floral reproductive organ than in a shoot apical meristem (SAM), and
(iv) mediates at least one of at least two-fold more expression, at least three-fold more expression, at least four fold-more expression, at least 5-fold more expression and at least six-fold more expression of the gRNA in the at least one of the floral primordia and the floral reproductive organ than in a seed;
b) regenerating the plant cell or plant tissue into a plant having a plurality of T1 seed; and
c) growing the T1 seed to produce a T1 generation, wherein the T1 generation contains at least one of at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique edits.
2. The method of 1, wherein the site-directed nuclease is operably linked to a constitutive promoter or to the FMOS promoter.
3. The method of 1, wherein the site-directed nuclease is a Cas nuclease.
4. The method of any of the above, further comprising
growing the T1 seed to produce a plurality of T1 plants, and
measuring at least one phenotype in plants of the T1 generation, and
selecting a plant of the T1 generation based on the measuring of at least one phenotype, wherein the selected plant has at least one unique edit.
5. The method of 4, further comprising crossing the selected plant of the T1 generation having a unique edit with a plant not having the unique edit to produce a progeny having the unique edit.
6. The method of any of the above, wherein the FMOS regulatory sequence mediates expression in at least one of an inflorescence, a microsporocyte, an anther, a stamen, a tapetum, megasporocyte, a pistil, an ovary, a style, and a stigma.
7. The method of any of the above, wherein the FMOS regulatory sequence mediates at least one of 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the gRNA in the floral primordia and the floral reproductive organ than in vegetative tissue, and
at least one of at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the gRNA in the floral primordia and the floral reproductive organ than in a seed.
8. The method of any of the above, wherein the FMOS regulatory sequence comprises an FMOS promotor and an FMOS terminator.
9. The FMOS promoter and terminator may be any of those disclosed herein.
10. The method of any of the above, wherein the at least one expression cassette does not comprise translatable exons that are native to the FMOS regulatory sequence. The FMOS promoter may include at least one of the first native exon modified to remove the start codon, the first intron, and at least a portion of the second exon, wherein the portion of the second exon is not translatable. Further, FMOS promoters may be modified to include a ubiquitin intron, for example, to boost FMOS activity in some examples.

11. The method of any of the above, wherein FMOS regulatory sequence
(i) mediates expression of the DNA modification enzyme in both a male and a female floral reproductive organ, and
(ii) mediates a plurality of unique point mutations in both a male and a female floral reproductive organ.

12. The method of any of the above, wherein the T0 plant has a mosaicism score of at least 0.5, 1, 1.5, 2, 3, 4, 5, 6, 7, 8, 9, 10, 11, 12, 13, 14, 15, 16 17, 18, 19, and 20, wherein the mosaicism score is determined by Mosaicism Score Methodology 1. The upper limit of the mosaicism score will be determined by the efficacy of the FMOS promoter, however, applicant expects typical mosaicism scores to be in the range of at least one of 0.5 to 30, 1 to 25, 2 to 25, 3 to 25, 4 to 25, 5 to 25, 6 to 25, 5 to 20, 5 to 19, 5 to 18, 5 to 17, 5 to 16, and 5 to 15.

13. At least one expression cassette including any combination of components described in 1-12.

14. A plant produced using a method disclosed in 1-12.

15. A plant cell comprising at least one expression cassette of claim 13.

SEQUENCE LISTING (724 sequences)

SEQ ID NO: 1 - DNA, 19314 bp, Artificial sequence
  synthesized
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttatagccgtttctttgttttttttcttctgttgagctccaactttatgaaacgtcgtaagctggtaattatgaaatgtaaggatttggagagagaaaaaaaacgggagggaaaaccatgcatgctgctgacgcgacggccggacgcagacgcaacaatgcccccggtgcggcgttgtcgagcagccactgcaccaccccacgcatcacctgcagtaatctagcgacgggtttttcttatttatttatttatttatttatttttcttctctccctccctccctcagatttgttttcgttttcattaatcgttattaccagcaattaattaactttatctattgatttaccaaaccgcaataaagaatatatatattcttttattaaggtccagtaataagcagcacagaagcgcaggtgcagcagcagcagcgtcagcgcccgaggcgcgcacgagagaaacagaggctgacgaggtggggcccgtgcgggccttgaccaatcggagttcgacaacagcctggccacccacaaacacacactccttcgcctcgcgccggccgtcgtcgcctccctccaccgaacgatccctcctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgaaggggcgcggcaaggtacagctgaagcggatagagaacaagataaaccggcaggtgaccttctccaagcgccggaacggcctgctcaagaaggcgcacgagatctccgtcctctgcgttgccgaggtcgccgtcatcgtcttctcccccaagggcaagctctacgagtacgccaccgactcccggtacgtacgaccaccttcaattcgtcacacaggcagtgtgtttgttgaattgaatacgtgcctgctatgctagctgcctgtcagtatggtccatccgttcgccatcagttcatctttctgcttcgtgctgctgttgtgtgtgtgcgccataccatgccatgccatgccatgccaccaacctggctgtgctgccgtttttggctcgcagccgccgatccccgacccgaaagctcatgctgctcttgccgttttcggccaccacccaccatggcctgctgtctggtcctccacgcctgcttccccagttccacttccatgcatggtggtcagttggctggcatggcagcagcagccgccttctggttcgtttgtgctgcctcaggatttgctttctactagctagtgtgctacagccgatcatttcatgctgctgcccgcgtcgatctgctccgctagctgcttcctcgtttcgggaaacctcgcccgccccgccattaactgattcacctgctttccttctgttgcggtgttgcctacgacgactgaaacctttcctttttggggattggcgtctgccgactccactaggcctccttttaattccttgttttatatacatgtacataagcttttgctgatgcagtggtacggtgcctttatttttatcggattacagtacgtgttagattgataacagcacgcaatcagatctagctttgcttgcttccttccttcctcgtcaaatctttctggcccttctcgatttgcgctccatcgtataattaattaaccatcactaatcacactttccccatttttctaaacaaaaaaaagtatcacatgttcctaatcacgcgtgcatgtaatttgctgtttctttctctctctctctcaattaatttgctgcctgccgagaaacacgagctgcatgctggctcaatcagttcctaactgcgaaagtgcagataatgaccccctcggctcggattaatcagtacacatgatcgaggacgcatagatctggcttttccttatctggttcttcgtcttcaattctccgtttcttccctcgcatccttttccgtgttgtttcagatttacaaataaaccatcgtctctctcactttcatctgttgttcttccatgacagtgaaaaatactgttttttcctcgggtgcatggaaaaattaaaattaaaggcccgtgtttttttctctttggatgtgttcttataggatggatacactatgtgcatccgggttttgtggtgatgtaacatagtaaagcagctccgaggtactgggttctatttcatattccccccccccccaaatcaaaaaagttatctttgctcgaaggtctactcgtttttttttctggcttttatacgaattctatgacatgctagtatgggtaaaaacgaaatggtgattctcattcgtatatgcactattatattctttgcatgcacttttattacaaaagctgcatggacgtgttacacattcacggagataacaattgagcagtagattagtttctgtcttcttaattagctaggcaggctcagaggtgaaactgcagctattaggttgagtaacacagctagtgctgtattcatgaagcttcggtttgactcagttttgcagtagcactggttgcaactcgctaaaccatttaacttccatgtacatgatgtctttgtaggagtttgtgttcattcttcttattttgacatttcaagtcattcagtacgtaactactaaaataagtgtcttgcagagtcagtctcaagataacttgttggtcttggcttattagctaagatgcaatgcatcattacttgccttactgtgatggctaaaccaatatcacatgcactgtgtgctttttcaagcattccacatccatacatacctagtatccctgactttttaatgacccctgatgatagaacatgcattgtttgtatattacctgttagtgttcttaacataaaattttacaaaagaagctctattacgaggatgttatgctgcttttgcaaaggaaactagctaggcagactggtgctttttaaataaacaattaaaatcttgtgaacccaaacactacttacagatcgaaaattacagtaagacgaaagtaaatggcaactagtacaatactcgtacatgcgttgcgacggcacataaaaacaaatattacgttttatcttagccaaagcgtctagaaaggtatgagttgaaaagaagactttttatagcttactcggtcgctgttcttcctttagctagcaagttaatactatatgggagcgctacgcagtgtgccgcttcctctcgtgttgggctcaggtggtttctcacagtccatctgtaaggtaacagcacactaataggagcttcagtgggcttatttatgagataacagcctactcattaatacacctacatgtgaaaggacgatcgtcgaaactggtgttttatagtagtagaaatgaactttgaggcatagcttctttgcaattccattgttagcttgtttttttgttttgaagatacatgtcgttagcttacttgttggattgcatgtaaacatgcatcatggttgctttagaaaattttgttgacgttgatgagtacatttctctatcgcagtacaagatatgtaatgatatagtacttgcatgctcgtgctttcttgcatatgattgcttttcgaaagggaatataaatgccctcgaaaatttacttatcccttgcaatgatctctggtttaagcatagattatttcaaggacttccaaagaaaatgatttgacattcttttttccccttttttcagctaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaagctacggagagggtcgatggatcatgacgtacgcgtaccatatggttgctgtgcctgcccccatcgatcgcgagcaatggcacgctcatgcaagtgatcattgctccctgttggttaaaccctagcctatgttcatggcgtcagcaactaagctaaactattgttatgtttgcaagaaagggtaaacccgctagctgtgtaatcttgtccagctaccatgtatgcttgttactgcccagttacccttgaaatctaggggcgcttttggtgagagggtgcagtttactttaaacatggttcgtgacttgctgtaaatagtagtattaatcgatttgggcatctagtaagtaaattaagggtgtgtttgatttggcttttactctctaaaagttaaaagctaaattaaagagctggatctagaaaatagacttttctaaaagccgactttgtgatggtgcaaaattgaaagcgtcttagcttttggctaaagagttgtttggtttgactcttttgtcctctaaaaaccaaaagtcaaaccaaagagctagatctaaaaacacgtttttttttctttctaaaaatcgtctttctcatttggacctacttttagtgtcttttaaagcatctttggacctactttttacggcttttaatggtttcactaaatggtttttaactttttaacaactcacaatctacatcaatttttttttcatagcttgtagtctacaacaacattttttacaacctacaatctaaccaaatagaccctaactaatgggagaatgaaaaaaaaatcgctcgatcttatgctattgatgcatgacatgtgaaaccatgaggctcatttttgaacgattggatacataaacctagcgatgcttcactgtgacatccggcgcatatctgtatgtttagtgtactttgtttctgtagtttttccttaagtgtagtgcaacttcttatctggtgttttattcggtgtatcgttgtaatcatctagtacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 2 - DNA, 3772 bp, Zea mays
gccgtttctttgttttttttcttctgttgagctccaactttatgaaacgtcgtaagctggtaattatgaaatgtaaggatttggagagagaaaaaaaacgggagggaaaaccatgcatgctgctgacgcgacggccggacgcagacgcaacaatgcccccggtgcggcgttgtcgagcagccactgcaccaccccacgcatcacctgcagtaatctagcgacgggtttttcttatttatttatttatttatttatttttcttctctccctccctccctcagatttgttttcgttttcattaatcgttattaccagcaattaattaactttatctattgatttaccaaaccgcaataaagaatatatatattcttttattaaggtccagtaataagcagcacagaagcgcaggtgcagcagcagcagcgtcagcgcccgaggcgcgcacgagagaaacagaggctgacgaggtggggcccgtgcgggccttgaccaatcggagttcgacaacagcctggccacccacaaacacacactccttcgcctcgcgccggccgtcgtcgcctccctccaccgaacgatccctcctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgaaggggcgcggcaaggtacagctgaagcggatagagaacaagataaaccggcaggtgaccttctccaagcgccggaacggcctgctcaagaaggcgcacgagatctccgtcctctgcgttgccgaggtcgccgtcatcgtcttctcccccaagggcaagctctacgagtacgccaccgactcccggtacgtacgaccaccttcaattcgtcacacaggcagtgtgtttgttgaattgaatacgtgcctgctatgctagctgcctgtcagtatggtccatccgttcgccatcagttcatctttctgcttcgtgctgctgttgtgtgtgtgcgccataccatgccatgccatgccatgccaccaacctggctgtgctgccgtttttggctcgcagccgccgatccccgacccgaaagctcatgctgctcttgccgttttcggccaccacccaccatggcctgctgtctggtcctccacgcctgcttccccagttccacttccatgcatggtggtcagttggctggcatggcagcagcagccgccttctggttcgtttgtgctgcctcaggatttgctttctactagctagtgtgctacagccgatcatttcatgctgctgcccgcgtcgatctgctccgctagctgcttcctcgtttcgggaaacctcgcccgccccgccattaactgattcacctgctttccttctgttgcggtgttgcctacgacgactgaaacctttcctttttggggattggcgtctgccgactccactaggcctccttttaattccttgttttatatacatgtacataagcttttgctgatgcagtggtacggtgcctttatttttatcggattacagtacgtgttagattgataacagcacgcaatcagatctagctttgcttgcttccttccttcctcgtcaaatctttctggcccttctcgatttgcgctccatcgtataattaattaaccatcactaatcacactttccccatttttctaaacaaaaaaaagtatcacatgttcctaatcacgcgtgcatgtaatttgctgtttctttctctctctctctcaattaatttgctgcctgccgagaaacacgagctgcatgctggctcaatcagttcctaactgcgaaagtgcagataatgaccccctcggctcggattaatcagtacacatgatcgaggacgcatagatctggcttttccttatctggttcttcgtcttcaattctccgtttcttccctcgcatccttttccgtgttgtttcagatttacaaataaaccatcgtctctctcactttcatctgttgttcttccatgacagtgaaaaatactgttttttcctcgggtgcatggaaaaattaaaattaaaggcccgtgtttttttctctttggatgtgttcttataggatggatacactatgtgcatccgggttttgtggtgatgtaacatagtaaagcagctccgaggtactgggttctatttcatattccccccccccccaaatcaaaaaagttatctttgctcgaaggtctactcgtttttttttctggcttttatacgaattctatgacatgctagtatgggtaaaaacgaaatggtgattctcattcgtatatgcactattatattctttgcatgcacttttattacaaaagctgcatggacgtgttacacattcacggagataacaattgagcagtagattagtttctgtcttcttaattagctaggcaggctcagaggtgaaactgcagctattaggttgagtaacacagctagtgctgtattcatgaagcttcggtttgactcagttttgcagtagcactggttgcaactcgctaaaccatttaacttccatgtacatgatgtctttgtaggagtttgtgttcattcttcttattttgacatttcaagtcattcagtacgtaactactaaaataagtgtcttgcagagtcagtctcaagataacttgttggtcttggcttattagctaagatgcaatgcatcattacttgccttactgtgatggctaaaccaatatcacatgcactgtgtgctttttcaagcattccacatccatacatacctagtatccctgactttttaatgacccctgatgatagaacatgcattgtttgtatattacctgttagtgttcttaacataaaattttacaaaagaagctctattacgaggatgttatgctgcttttgcaaaggaaactagctaggcagactggtgctttttaaataaacaattaaaatcttgtgaacccaaacactacttacagatcgaaaattacagtaagacgaaagtaaatggcaactagtacaatactcgtacatgcgttgcgacggcacataaaaacaaatattacgttttatcttagccaaagcgtctagaaaggtatgagttgaaaagaagactttttatagcttactcggtcgctgttcttcctttagctagcaagttaatactatatgggagcgctacgcagtgtgccgcttcctctcgtgttgggctcaggtggtttctcacagtccatctgtaaggtaacagcacactaataggagcttcagtgggcttatttatgagataacagcctactcattaatacacctacatgtgaaaggacgatcgtcgaaactggtgttttatagtagtagaaatgaactttgaggcatagcttctttgcaattccattgttagcttgtttttttgttttgaagatacatgtcgttagcttacttgttggattgcatgtaaacatgcatcatggttgctttagaaaattttgttgacgttgatgagtacatttctctatcgcagtacaagatatgtaatgatatagtacttgcatgctcgtgctttcttgcatatgattgcttttcgaaagggaatataaatgccctcgaaaatttacttatcccttgcaatgatctctggtttaagcatagattatttcaaggacttccaaagaaaatgatttgacattcttttttccccttttttcagc

SEQ ID NO: 3 - DNA, 1000 bp, Zea mays
ggagagggtcgatggatcatgacgtacgcgtaccatatggttgctgtgcctgcccccatcgatcgcgagcaatggcacgctcatgcaagtgatcattgctccctgttggttaaaccctagcctatgttcatggcgtcagcaactaagctaaactattgttatgtttgcaagaaagggtaaacccgctagctgtgtaatcttgtccagctaccatgtatgcttgttactgcccagttacccttgaaatctaggggcgcttttggtgagagggtgcagtttactttaaacatggttcgtgacttgctgtaaatagtagtattaatcgatttgggcatctagtaagtaaattaagggtgtgtttgatttggcttttactctctaaaagttaaaagctaaattaaagagctggatctagaaaatagacttttctaaaagccgactttgtgatggtgcaaaattgaaagcgtcttagcttttggctaaagagttgtttggtttgactcttttgtcctctaaaaaccaaaagtcaaaccaaagagctagatctaaaaacacgtttttttttctttctaaaaatcgtctttctcatttggacctacttttagtgtcttttaaagcatctttggacctactttttacggcttttaatggtttcactaaatggtttttaactttttaacaactcacaatctacatcaatttttttttcatagcttgtagtctacaacaacattttttacaacctacaatctaaccaaatagaccctaactaatgggagaatgaaaaaaaaatcgctcgatcttatgctattgatgcatgacatgtgaaaccatgaggctcatttttgaacgattggatacataaacctagcgatgcttcactgtgacatccggcgcatatctgtatgtttagtgtactttgtttctgtagtttttccttaagtgtagtgcaacttcttatctggtgttttattcggtgtatcgttgtaatcatctagta

SEQ ID NO: 4 - DNA, 4170 bp, Artificial Sequence
  synthesized vector component
atggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtga

SEQ ID NO: 5 - DNA, 106 bp, Artificial Sequence
  synthesized vector component
acggcaagccactgtcgatcggttttagagctagaaatagcaagttaaaataaggctagtccgttatcaacttgaaaaagtggcaccgagtcggtgcttttttttt

SEQ ID NO: 6 - DNA, 20 bp, Artificial Sequence
  synthesized vector component
cggcaagccactgtcgatcg

SEQ ID NO: 7 - DNA, 12 bp, Artificial Sequence
  synthesized vector component
gttttagagcta

SEQ ID NO: 8 - DNA, 69 bp, Artificial Sequence
  synthesized vector component
tagcaagttaaaataaggctagtccgttatcaacttgaaaaagtggcaccgagtcggtgcttttttttt

SEQ ID NO: 9 - DNA, 375 bp, Artificial Sequence
  synthesized vector component
gggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggc

SEQ ID NO: 10 - DNA, 15181 bp, Artificial Sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctggcagacaaagtggcagacatactgtcccacaaatgaagatggaatctgtaaaagaaaacgcgtgaaataatgcgtctgacaaaggttaggtcggctgcctttaatcaataccaaagtggtccctaccacgatggaaaaactgtgcagtcggtttggctttttctgacgaacaaataagattcgtggccgacaggtgggggtccaccatgtgaaggcatcttcagactccaataatggagcaatgacgtaagggcttacgaaataagtaagggtagtttgggaaatgtccactcacccgtcagtctataaatacttagcccctccctcattgttaagggagcaaaatctcagagagatagtcctagagagagaaagagagcaagtagcctagaagtcctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 11 - DNA, 397 bp, Artificial sequence
  synthesized vector component
tggcagacaaagtggcagacatactgtcccacaaatgaagatggaatctgtaaaagaaaacgcgtgaaataatgcgtctgacaaaggttaggtcggctgcctttaatcaataccaaagtggtccctaccacgatggaaaaactgtgcagtcggtttggctttttctgacgaacaaataagattcgtggccgacaggtgggggtccaccatgtgaaggcatcttcagactccaataatggagcaatgacgtaagggcttacgaaataagtaagggtagtttgggaaatgtccactcacccgtcagtctataaatacttagcccctccctcattgttaagggagcaaaatctcagagagatagtcctagagagagaaagagagcaagtagcctagaagt

SEQ ID NO: 12 - DNA, 253 bp, Artificial Sequence
  synthesized vector component
gatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 13 - DNA, 4170 bp, Artificial sequence; identical to SEQ ID NO: 4
  synthesized vector component

SEQ ID NO: 14 - DNA, 106 bp, Artificial sequence; identical to SEQ ID NO: 5
  synthesized vector component

SEQ ID NO: 15 - DNA, 20 bp, Artificial sequence
  synthesized vector component
cggcaagccactgtcgatcg

SEQ ID NO: 16 - DNA, 12 bp, Artificial sequence
  synthesized vector component
gttttagagcta

SEQ ID NO: 17 - DNA, 69 bp, Artificial sequence; identical to SEQ ID NO: 8
  synthesized vector component

SEQ ID NO: 18 - DNA, 375 bp, Artificial sequence; identical to SEQ ID NO: 9
  synthesized vector component

SEQ ID NO: 19 - DNA, 16902 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaagccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 20 - DNA, 2117 bp, Artificial sequence
  derived from Zea mays
gccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgcc

SEQ ID NO: 21 - DNA, 253 bp, Artificial sequence; identical to SEQ ID NO: 12
  vector component

SEQ ID NO: 22 - DNA, 17799 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaagccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 23 - DNA, 2117 bp, Artificial Sequence; identical to SEQ ID NO: 20
  derived from Zea mays

SEQ ID NO: 24 - DNA, 1152 bp, Artificial Sequence
  derived from Zea mays
gttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgca

SEQ ID NO: 25 - DNA, 18769 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaatatctatgttaaaatattagatttttcatataagtcagatgttttaggaccatctctatcgttgtgtgatattgatacttatgaatcatgataatattttattatggttttttattgttgggttatttattatacattataagatcaccttatttaaccagaacaaggaataacaacttgagaaaacagtacaaccaaaaggactattatgactactgttctggctaattaattagagaagttagtgtgtgagaaccttacccaaaagggacaagtggagagtagttactcaagtatagagaggttctcgggctgatctgctctatggtagcttttcagacgagatattcctataccacctctgcttgaaatcgtagcgggttttctcatgctactgcaactttgtaaaggtctcgtagtgaatcctgtcctacctcctataaagaggtgaatgatctagctaacctgaggcaaatgagaaatacgacttgtgggtaaagatgtgcaatctctgtagagtgtaaaactgatatatgagccgtgcgtactgtcaagagcggttcgggcctctcgcatagttaaattataaaattgaattaaaacagacatgcattttattgttggtattgtctctatgatcatttatttaactaatactttatgtacttacatttagtaattgctaataaaattttgaccaacaaaatttaaaagtaatgattagcttcacctacattacttggtaagccttacattgcacttttttctacaaattttgctgagtacacaccataaatgtacttacccttgcggaatttgttgctcagaactatagatggccagccgggccgggctaaacgggccggcccgaagcacggcacggcccgtagtgcctgggcacggcacgacacggctagtgtcgggcccgtgccggcacggcccgataggtagtgccgtgcctgggccgagcatcaggcacgctgggccggcacgggcacggcacgattagcccctaggcacggttaggcacgattatacatgattagatccaagcacgagtagttagctgtgtgttgtactcttttttcttatatagggttttctcacaagggtgagtttttatctaaataggtttttaatgagtcagccattgcactaaacagttcaatattagctattttagtatgttttaactgtgtttgtgaatatctgactaaaattctgtggtatagtgctaaacgggctaaacgggctaaacgggccggcacggcacggctaagcaggcttagtgccgtgcttgggcctggccttaggcactagtgccgtgccggcacggcacggctattaaacgggctaaacgggtcgtgccctaaccgtgtcgtgcctggccgtgcccgggccgggccgtgccgtgccgcccatttggccatctctactcataaccaagtcaccaagtcaccaagaggaagactactatgatgagttcgagcctgtcgtcgccacatcttgtgatcgggttcgtcgtcactgtaatcgttgtttagtttccattatttagttaatttttgtaaagacattatgcttatataatagagtttgtgacactagtttgtacactgagtaatcatatgtgtaaaacttctgacacacatatgaaatatatttaggtttatctttaaatctggtgtgatagttttcatgagagaaatcttggtgtagagtgcagtactaaaaaaattacaatcgtgtcaaaaccgtagtattcaaacactatatcataaagttcacccaaacacccaaacactatatcataaaatgcctttacaaccgaccctaaaccgcggaggcattccatattgtccatagagataaagcggccaatccgggtcgtgggtcgtggccaagggtgtggaggtggtgccatggttgcgccggaaagacctggtgggtccgcgcctgacgacttgctgaagaatcgtttcctccacacctatatattgggccctgcgctacacaggcactggcggcctccagcaccagtgtggcaacacaacagtatacagagcgcagggcgaaccacgtgacagaggaagtcgtgcagacggcgaggcagcccaacggttgttcggccggccatttcgcaatctctcctcgccgctcatccctgagcgcacgcaaaagaaaggttgcccatcgttgcgcaccggttctctgtgcgacgtttgtttgtctcttttaggatcctttggggttttctcttctttcgaacgcgttgagttcttctctgtgcgacgcggtctgggtttgggatctagtgcggtgacttctcgtcttccttgtctggcgacgattagaaaaggactcgccctcgccatcgccatcgccatcgcccggttgttgcttggctctttctctttgtctcgcacggtcatttcttcttgacacacttcggtttcttttttttttcttttgcttcctagtttggacacaaggtttatttgaaaaagcgggattgttgatccctacctatgtgttccatttcatatgtatatattttctaatatttttgtaaaacgactgttgtgcgaaaagattggggttttgtggcctaccacatagtcgtgggcctcgtggggttttagatgacgaactccgcgttggttttctgagtcgtggggttttcgatgacgaatggtgttctatataaataaagtttaatcatttatggaatttatcatgcgagctagccttcctcttccgcgtttcttcttggagatattaacgtcaaatggtgcaatgcgattttttcccccattgccatttgccccgcctacgccttccatctttatttccatctcccgtaactccgttcccttcctttcttttcacgccactgtggttttactagtagctgatcatggcgctcgttcctttcctagggacgtgagtagctgcatttaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcatttaatccttgaccacgggaaaccctttcctgaacaaggctttgctcttctgaagactgaacaaggctgctgcattatttattatgaacaagcctgaacaaggctgcattatactagcttaacgtttgtagtttgcattttatttcatataaacgatccaagtctttgccgaacttgattattatattcagttattcagcattcacgggacgctagagggaaaaatcgaaattttgaaacgctttggtgaaccattttatattcagttaagcattccaattaaggcattgttcggttattttaatttcatgcgtattggtgtatatttggatggaatttgacttattatggatttaaactgattcaataccacccaatccacatggattaacgatgaaacgaaccagccctaaggtttccctgtaactagttgcatgaattttattcatcaactgttttttcgacggctagagagaaaatcaaaataaagatggatacatgtaagatcgaaactactaggaattgatggcgcagtaaactgtcatgtcctgtacagtttgcttatggttcaccaaagcgtttagaatctatccttgaaaaaaacgatatcgatatctttggaaatattggcgttcggctttagactaattctacttcggtgttgctgcaatgtagataattgatgacatgattgattcgttttatctattattttatatatattaaaaactatagactgttttagctttgccctaaattaaatttgtaactttgggcaatttttaaatagcagaatctagaatatattttatcttatttttctcattttttttaaaaaaacatgtatcttgataatgtatttatttgaacacgttgataacattttgtatctgaatccatgagtcagtaatttttgaacagacacggagaagctctcatccattctggtggcagaggaccggaaccaacatcattttttaaaaaaaactacagtggaaagaagaatatccattatgtttttgggaagttactgtagcccagggttctttggaactcctgtagtatttttataaataaacttctcgtaaagcctttttttaaaaaaaatggatctaaaacttgagtcatagaccaatgtgccgagaattggtgtcaggccacattcagctcttgcacagggtcgttcctgatttttgagggacccgggacaagattataaacgtaggccccagcaccataaaaactattttttactattatatatactccctccgtttcgttttagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 26 - DNA, 2956 bp, Artificial Sequence
  derived from Zea mays
tatctatgttaaaatattagatttttcatataagtcagatgttttaggaccatctctatcgttgtgtgatattgatacttatgaatcatgataatattttattatggttttttattgttgggttatttattatacattataagatcaccttatttaaccagaacaaggaataacaacttgagaaaacagtacaaccaaaaggactattatgactactgttctggctaattaattagagaagttagtgtgtgagaaccttacccaaaagggacaagtggagagtagttactcaagtatagagaggttctcgggctgatctgctctatggtagcttttcagacgagatattcctataccacctctgcttgaaatcgtagcgggttttctcatgctactgcaactttgtaaaggtctcgtagtgaatcctgtcctacctcctataaagaggtgaatgatctagctaacctgaggcaaatgagaaatacgacttgtgggtaaagatgtgcaatctctgtagagtgtaaaactgatatatgagccgtgcgtactgtcaagagcggttcgggcctctcgcatagttaaattataaaattgaattaaaacagacatgcattttattgttggtattgtctctatgatcatttatttaactaatactttatgtacttacatttagtaattgctaataaaattttgaccaacaaaatttaaaagtaatgattagcttcacctacattacttggtaagccttacattgcacttttttctacaaattttgctgagtacacaccataaatgtacttacccttgcggaatttgttgctcagaactatagatggccagccgggccgggctaaacgggccggcccgaagcacggcacggcccgtagtgcctgggcacggcacgacacggctagtgtcgggcccgtgccggcacggcccgataggtagtgccgtgcctgggccgagcatcaggcacgctgggccggcacgggcacggcacgattagcccctaggcacggttaggcacgattatacatgattagatccaagcacgagtagttagctgtgtgttgtactcttttttcttatatagggttttctcacaagggtgagtttttatctaaataggtttttaatgagtcagccattgcactaaacagttcaatattagctattttagtatgttttaactgtgtttgtgaatatctgactaaaattctgtggtatagtgctaaacgggctaaacgggctaaacgggccggcacggcacggctaagcaggcttagtgccgtgcttgggcctggccttaggcactagtgccgtgccggcacggcacggctattaaacgggctaaacgggtcgtgccctaaccgtgtcgtgcctggccgtgcccgggccgggccgtgccgtgccgcccatttggccatctctactcataaccaagtcaccaagtcaccaagaggaagactactatgatgagttcgagcctgtcgtcgccacatcttgtgatcgggttcgtcgtcactgtaatcgttgtttagtttccattatttagttaatttttgtaaagacattatgcttatataatagagtttgtgacactagtttgtacactgagtaatcatatgtgtaaaacttctgacacacatatgaaatatatttaggtttatctttaaatctggtgtgatagttttcatgagagaaatcttggtgtagagtgcagtactaaaaaaattacaatcgtgtcaaaaccgtagtattcaaacactatatcataaagttcacccaaacacccaaacactatatcataaaatgcctttacaaccgaccctaaaccgcggaggcattccatattgtccatagagataaagcggccaatccgggtcgtgggtcgtggccaagggtgtggaggtggtgccatggttgcgccggaaagacctggtgggtccgcgcctgacgacttgctgaagaatcgtttcctccacacctatatattgggccctgcgctacacaggcactggcggcctccagcaccagtgtggcaacacaacagtatacagagcgcagggcgaaccacgtgacagaggaagtcgtgcagacggcgaggcagcccaacggttgttcggccggccatttcgcaatctctcctcgccgctcatccctgagcgcacgcaaaagaaaggttgcccatcgttgcgcaccggttctctgtgcgacgtttgtttgtctcttttaggatcctttggggttttctcttctttcgaacgcgttgagttcttctctgtgcgacgcggtctgggtttgggatctagtgcggtgacttctcgtcttccttgtctggcgacgattagaaaaggactcgccctcgccatcgccatcgccatcgcccggttgttgcttggctctttctctttgtctcgcacggtcatttcttcttgacacacttcggtttcttttttttttcttttgcttcctagtttggacacaaggtttatttgaaaaagcgggattgttgatccctacctatgtgttccatttcatatgtatatattttctaatatttttgtaaaacgactgttgtgcgaaaagattggggttttgtggcctaccacatagtcgtgggcctcgtggggttttagatgacgaactccgcgttggttttctgagtcgtggggttttcgatgacgaatggtgttctatataaataaagtttaatcatttatggaatttatcatgcgagctagccttcctcttccgcgtttcttcttggagatattaacgtcaaatggtgcaatgcgattttttcccccattgccatttgccccgcctacgccttccatctttatttccatctcccgtaactccgttcccttcctttcttttcacgccactgtggttttactagtagctgatcatggcgctcgttcctttcctagggacgtgagtagctgca

SEQ ID NO: 27 - DNA, 1280 bp, Artificial Sequence
  derived from Zea mays
tccttgaccacgggaaaccctttcctgaacaaggctttgctcttctgaagactgaacaaggctgctgcattatttattatgaacaagcctgaacaaggctgcattatactagcttaacgtttgtagtttgcattttatttcatataaacgatccaagtctttgccgaacttgattattatattcagttattcagcattcacgggacgctagagggaaaaatcgaaattttgaaacgctttggtgaaccattttatattcagttaagcattccaattaaggcattgttcggttattttaatttcatgcgtattggtgtatatttggatggaatttgacttattatggatttaaactgattcaataccacccaatccacatggattaacgatgaaacgaaccagccctaaggtttccctgtaactagttgcatgaattttattcatcaactgttttttcgacggctagagagaaaatcaaaataaagatggatacatgtaagatcgaaactactaggaattgatggcgcagtaaactgtcatgtcctgtacagtttgcttatggttcaccaaagcgtttagaatctatccttgaaaaaaacgatatcgatatctttggaaatattggcgttcggctttagactaattctacttcggtgttgctgcaatgtagataattgatgacatgattgattcgttttatctattattttatatatattaaaaactatagactgttttagctttgccctaaattaaatttgtaactttgggcaatttttaaatagcagaatctagaatatattttatcttatttttctcattttttttaaaaaaacatgtatcttgataatgtatttatttgaacacgttgataacattttgtatctgaatccatgagtcagtaatttttgaacagacacggagaagctctcatccattctggtggcagaggaccggaaccaacatcattttttaaaaaaaactacagtggaaagaagaatatccattatgtttttgggaagttactgtagcccagggttctttggaactcctgtagtatttttataaataaacttctcgtaaagcctttttttaaaaaaaatggatctaaaacttgagtcatagaccaatgtgccgagaattggtgtcaggccacattcagctcttgcacagggtcgttcctgatttttgagggacccgggacaagattataaacgtaggccccagcaccataaaaactattttttactattatatatactccctccgtttcgttttag

SEQ ID NO: 28 - DNA, 17645 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccactgattagacttactgattgttggcgcgcgccaggatcagctgggtcgacgatgtcagaagaccacgagcagtcgcgtgaagacgcttcccaaaaaccttattcgccctctcccggtgcaggatctagaagacgaagggttccggagacctgctctcctgatcgcagatgcacctctgcggtcgggacgaagggaactaaaaggcggctcagctatgaagagaggcgaaggcgaactgggatctgggatgatctggaggctggctgccgggctccttttatagggccaagtccgcgacccccgtgcttatccgcccacgaaaatctcgcaatcagttgagattttatagcgatcggttaggataagcgtaacagccaagaaaccaaaaaatcaaacggcaaaaggtagccgcgcccccgcaaggcgaggggccggatttcggcggaccattcacgcgcatgtcgtgcgcccgcgcccttcgccccgccccgccccgccccggcccggcccggcccggccaggcgagcgagcgcgcgcgcgcgtgtggctctccacactctctcctctcatccatgacttggtgagtgagtgtggcttccatatttaagttagctctactccataagagctagcaatatggtgctattggttccacctatccctttgccatccacttatatgggcttttgagattttcctgtgatttattagaaattcttaattgggccaagcccataaatcctaacattattgacgaaaaaccgacggtaaaccgccccaaagtgtcgattttccatgaaaatgaaccggttttcgctgttttttacagaaaatggaaaattttgacaatatttatttgtaatttactcaattcacattgcacagtaaatattaattgatccacacgacatgtgtttaccaaaataacatatagcatgcatatgcaacaaacaaccagcaatacttaaatactagttcttttatagttcttcaacgacatataggttgacttgtttcacaatactcatgtattcaacacgagtcatagtgatagtattcaggtatgttggaagaatcgtgatatggtctctcatcccacccccttgcaccactccccttacagcatatgatccaactgtttcattggcccattcttgcacttcatctgtgtctccttgttcgtgtacaagtgatataaacaacatgctagaaagatgagtgtcactattaggtgaatctttgtccaatgtcgaaggtgtattggaactaaactagcacttaaactggacaaaaaatagcatctaacagtaaataatcttcacatataccatataatagtaaacaaactaatacgactaaactgaacactaaatgactaaaccgaaactaaatcttaacatcaaatccggtttccccaaaaaaaatgtggttaccagttcaaaatgacggttcacatatatccgttttttatcaattatttttaattgttttgaatttaggacgaattttgaagaaaaaaaccgttggttaaactgaccggtttccccaccaaatgctcaggccggaagacttcagcgtaccaccggtcttctgcttgcccaccttggctataaaagctgcccgcagcgtgcgggtgctattcagtttcttcgctcttcatttcgccttccacggttctttccacctagcaaaaccccaagcctccttcctacgttaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcttaattgctcagcgcgagctgcatgtcttgattcaggctgcctcaatatacaagaggccttttttttgtgataaactggtatcgatggttgtcctgactattttgcatcagtggctgctaattagggcttgtttgataacaatgtttcttaaaatcatgattttacattttttttaattgtcaggatgataccgtagttttcaatcagctccaagaatattatatgttatttggatacaatattagaaaacatggtatttgctagacaaaagcaagtcttgttatgaaaactttgggatggtaccataattttgaaaacatagttcttataaatacaatcaaatatctggtgctataagatactctgatattcctataaaccataatattgtttaaaactataagaatattttacctccaaacatatcctaataattagttgtggttttgttttttccctttaacaaaatattcatagaatttggcgacaaacttataccttgctaaaatttaaagaaacatgaaaaaaataaagagtatacagagtcgatttatttattgtcttgttagaaaccatatacgagaaacttgacaaaaactcacaatgataaaaaataataattcatattgaaaattaaagaaagaaatataagaaataacatggaataaaaataaaaatagaaaataataactaattagaatgaaataaaaagaaattataaaaataaggagaagattaaaaaataaaaataaataaaacaagaaaaaaggaacccgacacccacactatccggtctaaggctatgttccaaatctataaaaccaataattagcggctaaaattatataagaggtttagaatgggttaactaatgaaccagttaattactagctataattttcaaataactattagttgttagttaccacaacctagctaaattagataatagattgttgatgaccaaattgcctctaaccctttgtacctactagcttataaaggacattaagcttatcataagactgtctacgacagaccgtgctatgataatgtaaaacattgttgtgtgctgcatagtgcactatttacaaagtagagtttgaaattgaaggcataatagaaaagctgctagagacaaatagttggttggctaattcagctaacaacgtattagctggctaataatttgccctagaggttcagaacatatatacgtggtgtttgaatgcactagagcaaatagttggttagctaaaaaattgctagtggaattagctagctagccattagttgatttactaaaagtagctaatagttgaaataaagttgtttgaatttgttcagtaaattttaatagctaactattagaaaagatggctagcgaacgagagtagatcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 29 - DNA, 1714 bp, Artificial Sequence
  derived from Zea mays
actgattagacttactgattgttggcgcgcgccaggatcagctgggtcgacgatgtcagaagaccacgagcagtcgcgtgaagacgcttcccaaaaaccttattcgccctctcccggtgcaggatctagaagacgaagggttccggagacctgctctcctgatcgcagatgcacctctgcggtcgggacgaagggaactaaaaggcggctcagctatgaagagaggcgaaggcgaactgggatctgggatgatctggaggctggctgccgggctccttttatagggccaagtccgcgacccccgtgcttatccgcccacgaaaatctcgcaatcagttgagattttatagcgatcggttaggataagcgtaacagccaagaaaccaaaaaatcaaacggcaaaaggtagccgcgcccccgcaaggcgaggggccggatttcggcggaccattcacgcgcatgtcgtgcgcccgcgcccttcgccccgccccgccccgccccggcccggcccggcccggccaggcgagcgagcgcgcgcgcgcgtgtggctctccacactctctcctctcatccatgacttggtgagtgagtgtggcttccatatttaagttagctctactccataagagctagcaatatggtgctattggttccacctatccctttgccatccacttatatgggcttttgagattttcctgtgatttattagaaattcttaattgggccaagcccataaatcctaacattattgacgaaaaaccgacggtaaaccgccccaaagtgtcgattttccatgaaaatgaaccggttttcgctgttttttacagaaaatggaaaattttgacaatatttatttgtaatttactcaattcacattgcacagtaaatattaattgatccacacgacatgtgtttaccaaaataacatatagcatgcatatgcaacaaacaaccagcaatacttaaatactagttcttttatagttcttcaacgacatataggttgacttgtttcacaatactcatgtattcaacacgagtcatagtgatagtattcaggtatgttggaagaatcgtgatatggtctctcatcccacccccttgcaccactccccttacagcatatgatccaactgtttcattggcccattcttgcacttcatctgtgtctccttgttcgtgtacaagtgatataaacaacatgctagaaagatgagtgtcactattaggtgaatctttgtccaatgtcgaaggtgtattggaactaaactagcacttaaactggacaaaaaatagcatctaacagtaaataatcttcacatataccatataatagtaaacaaactaatacgactaaactgaacactaaatgactaaaccgaaactaaatcttaacatcaaatccggtttccccaaaaaaaatgtggttaccagttcaaaatgacggttcacatatatccgttttttatcaattatttttaattgttttgaatttaggacgaattttgaagaaaaaaaccgttggttaaactgaccggtttccccaccaaatgctcaggccggaagacttcagcgtaccaccggtcttctgcttgcccaccttggctataaaagctgcccgcagcgtgcgggtgctattcagtttcttcgctcttcatttcgccttccacggttctttccacctagcaaaaccccaagcctccttcctacg

SEQ ID NO: 30 - DNA, 1396 bp, Artificial Sequence
  derived from Zea mays
ttgctcagcgcgagctgcatgtcttgattcaggctgcctcaatatacaagaggccttttttttgtgataaactggtatcgatggttgtcctgactattttgcatcagtggctgctaattagggcttgtttgataacaatgtttcttaaaatcatgattttacattttttttaattgtcaggatgataccgtagttttcaatcagctccaagaatattatatgttatttggatacaatattagaaaacatggtatttgctagacaaaagcaagtcttgttatgaaaactttgggatggtaccataattttgaaaacatagttcttataaatacaatcaaatatctggtgctataagatactctgatattcctataaaccataatattgtttaaaactataagaatattttacctccaaacatatcctaataattagttgtggttttgttttttccctttaacaaaatattcatagaatttggcgacaaacttataccttgctaaaatttaaagaaacatgaaaaaaataaagagtatacagagtcgatttatttattgtcttgttagaaaccatatacgagaaacttgacaaaaactcacaatgataaaaaataataattcatattgaaaattaaagaaagaaatataagaaataacatggaataaaaataaaaatagaaaataataactaattagaatgaaataaaaagaaattataaaaataaggagaagattaaaaaataaaaataaataaaacaagaaaaaaggaacccgacacccacactatccggtctaaggctatgttccaaatctataaaaccaataattagcggctaaaattatataagaggtttagaatgggttaactaatgaaccagttaattactagctataattttcaaataactattagttgttagttaccacaacctagctaaattagataatagattgttgatgaccaaattgcctctaaccctttgtacctactagcttataaaggacattaagcttatcataagactgtctacgacagaccgtgctatgataatgtaaaacattgttgtgtgctgcatagtgcactatttacaaagtagagtttgaaattgaaggcataatagaaaagctgctagagacaaatagttggttggctaattcagctaacaacgtattagctggctaataatttgccctagaggttcagaacatatatacgtggtgtttgaatgcactagagcaaatagttggttagctaaaaaattgctagtggaattagctagctagccattagttgatttactaaaagtagctaatagttgaaataaagttgtttgaatttgttcagtaaattttaatagctaactattagaaaagatggctagcgaacgagagtagat

SEQ ID NO: 31 - DNA, 17924 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaaatcattctcacttcgaacacgcgacccctcaagtaaatatgctcgtagctatcactacacctcatgtgtgtttatgtctacatctattatagtaaaaacacatactacatctctctcaaagcccacctgctacccttgcacaatgtgtagtagtagataaatatcaccgagattattaaattatatttttggattgagggagtagtatttaaagaagagccttgcatgcaatttcttttgtttgaataatgttttcaacttaaattccttttttgcatgtgcgacatttattctccgtaatatttttccatggatttaacttataagtcattttcataaaccaatgccaaagatgaatccatgtttcttacttggaaaccccaaacaaacaccactagcacgaggcgctcgcgttggcgtcgctcatcgacgacgagaagaaacttggcgactgccagttcgacctatagaagcagtcctacgtgccccatgcgccgctgtgtacggtaagctccggcgcagccgccgcttggacgcggtccagagcggttgcaccgcgctgtccattgtcaaacatggggacctcatggtcgtcgccaatgccgacgactctcgggttgttctgggcaccgcaaccgacaaagacgccatcacgccgtccagctcatcatccacctgaagcccaacctgccacgtaagttgctactgatcggccatgaattcttgtgcactgggatgacggccattgttgctattgtgtgagcgttctcgaacaagatgtatgtagaggagtagcatatccggtggtgcaacgaccaggtgtactacctcgctgatgagcccggagtgcacttcatttggcagcccagccaacagtcatcggtactcaccatgtcgcgtgcgttcgacgactactatatcaaggattgtgacgtcatctcggcgccggaggtgagcagaggaggaccgacaacaatgaccactcaccatcgtcggggtagcttttgtgttggcctgtctttaattctcttcgcaaacacacacttgtattttttttgtttaagcaagcgtgtatggcggtgcgtgcctgatgactaacgatgtacgacggaacttctatcggcaggtgtggtacgtgctctctaatgatgagaccatgcaaattatgacatatatcgaagtctgtatgatactgatggttgcaatgtagtagtgaaacaactaaattaaaataacaaaatttatgtatggctaggatcacaaatggattatgaaatattttcttataataatataagacacattttgtatataagttatcatagtattatatgttcccgttgcaacgcacgggtactatacatgaggagtgggttgattccactaaaattgatggaatgaacttattatgcatcaactcataaagcatagagtgattccacaaaccaaacacaccattagtttattgaccaacctcagttctttgatatataaaagttgtttgatccgtgtgcaacaaatagtttttcaggaatttgggacgtaccccatctcttaaatgtctagactgattggacatattaatctaattttagtagctaagtattagctctcaaacacctcctgggaatgctgccctaaaaatggaatatcggtacgtcggatcggagaaaggttggggtatcgtggtccaaagcatgcgaaagcaacggcgcagggctggaaacctgagaccaggtgaggtgcacgacgacatgcatatggtttgggttaggcctaggagctggttctctctccatgcatggtcagctcgccgcttttgccgccttcgtgtatggcttgccccatgccatgcatcgcgccgtgtacacttgtggcgtaggggcggggccgccgcatcggagcgcccccgtttcggcacggtcctcccagttttagggtaaacccagctagggtagtgggggtaactggccagcgccactccaaatctaccctccttcaatttaaagctgagaaatactgtagtatatactagagtagagcgagagaagggagatgtggatagatgggtggatggggacgcgtgaaaaagatgcgagagagaagagacgaccggacaggcagccacacacagtaacagtagtgaaccctgccccttttcccggtctctccactgatattccgctcctgtccctgtcctccccggacggagctaatagagccggctctgctcatcattatatcgtcgcgcacaaatgcgaagcctagcagcacttgtgtccggcggccttgtgttcgtgggggatgtgtggcatattagctagctgataagcggccggccgaagagcaagcgcagtgagaagaagaagctcggatcggaggaggtcggctaaaacatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattcaaagttatctgcaccgtaattattatatgctccatttgtcccttctggcctaggcgcctattaataaagcatagagagacacagatattacaaaacatatcaactaagctagaccgcaccagcactaccggaatatgggtctttaccgagtgctttttatcgcgcactcggcaaagaagactttaccgagcgccgcactcggcaaagtcctgcgctcgataaagagcttgtttaccgagtgcaggacactcggcacaacgaagcactcggcaaagactgctttgccgagcgtcaaacactcgacaaagatggctctcgacaaagggccgttagcagccgtctacagctgacagccgccagtctttgccgaaggccgaaagccggcacttgacaaagccgattctttgccgagtgttaaatatctggcactcggcaaagagagtctttgtcgagtgtcttctgtggacactcgacaaatcatttttttattttttttattttggccaccaaactttttgtggtatgttcctacactatgtagacctacatctaccattttgggacaatttgttggggcgaaggcaaagacgccacccttcgctcgaggccttcgctgcagtcgctggtctgacatagacaaaacgggcagggacacccttcgctcggttcagcaccagacgaaggtctgcgacggcgtcatcccacagtgctgcctcgcccagctcagaggccggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 32 - DNA, 2389 bp, Artificial Sequence
  derived from Zea mays
tcattctcacttcgaacacgcgacccctcaagtaaatatgctcgtagctatcactacacctcatgtgtgtttatgtctacatctattatagtaaaaacacatactacatctctctcaaagcccacctgctacccttgcacaatgtgtagtagtagataaatatcaccgagattattaaattatatttttggattgagggagtagtatttaaagaagagccttgcatgcaatttcttttgtttgaataatgttttcaacttaaattccttttttgcatgtgcgacatttattctccgtaatatttttccatggatttaacttataagtcattttcataaaccaatgccaaagatgaatccatgtttcttacttggaaaccccaaacaaacaccactagcacgaggcgctcgcgttggcgtcgctcatcgacgacgagaagaaacttggcgactgccagttcgacctatagaagcagtcctacgtgccccatgcgccgctgtgtacggtaagctccggcgcagccgccgcttggacgcggtccagagcggttgcaccgcgctgtccattgtcaaacatggggacctcatggtcgtcgccaatgccgacgactctcgggttgttctgggcaccgcaaccgacaaagacgccatcacgccgtccagctcatcatccacctgaagcccaacctgccacgtaagttgctactgatcggccatgaattcttgtgcactgggatgacggccattgttgctattgtgtgagcgttctcgaacaagatgtatgtagaggagtagcatatccggtggtgcaacgaccaggtgtactacctcgctgatgagcccggagtgcacttcatttggcagcccagccaacagtcatcggtactcaccatgtcgcgtgcgttcgacgactactatatcaaggattgtgacgtcatctcggcgccggaggtgagcagaggaggaccgacaacaatgaccactcaccatcgtcggggtagcttttgtgttggcctgtctttaattctcttcgcaaacacacacttgtattttttttgtttaagcaagcgtgtatggcggtgcgtgcctgatgactaacgatgtacgacggaacttctatcggcaggtgtggtacgtgctctctaatgatgagaccatgcaaattatgacatatatcgaagtctgtatgatactgatggttgcaatgtagtagtgaaacaactaaattaaaataacaaaatttatgtatggctaggatcacaaatggattatgaaatattttcttataataatataagacacattttgtatataagttatcatagtattatatgttcccgttgcaacgcacgggtactatacatgaggagtgggttgattccactaaaattgatggaatgaacttattatgcatcaactcataaagcatagagtgattccacaaaccaaacacaccattagtttattgaccaacctcagttctttgatatataaaagttgtttgatccgtgtgcaacaaatagtttttcaggaatttgggacgtaccccatctcttaaatgtctagactgattggacatattaatctaattttagtagctaagtattagctctcaaacacctcctgggaatgctgccctaaaaatggaatatcggtacgtcggatcggagaaaggttggggtatcgtggtccaaagcatgcgaaagcaacggcgcagggctggaaacctgagaccaggtgaggtgcacgacgacatgcatatggtttgggttaggcctaggagctggttctctctccatgcatggtcagctcgccgcttttgccgccttcgtgtatggcttgccccatgccatgcatcgcgccgtgtacacttgtggcgtaggggcggggccgccgcatcggagcgcccccgtttcggcacggtcctcccagttttagggtaaacccagctagggtagtgggggtaactggccagcgccactccaaatctaccctccttcaatttaaagctgagaaatactgtagtatatactagagtagagcgagagaagggagatgtggatagatgggtggatggggacgcgtgaaaaagatgcgagagagaagagacgaccggacaggcagccacacacagtaacagtagtgaaccctgccccttttcccggtctctccactgatattccgctcctgtccctgtcctccccggacggagctaatagagccggctctgctcatcattatatcgtcgcgcacaaatgcgaagcctagcagcacttgtgtccggcggccttgtgttcgtgggggatgtgtggcatattagctagctgataagcggccggccgaagagcaagcgcagtgagaagaagaagctcggatcggaggaggtcggc

SEQ ID NO: 33 - DNA, 1000 bp, Artificial sequence
  derived from Zea mays
gttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattcaaagttatctgcaccgtaattattatatgctccatttgtcccttctggcctaggcgcctattaataaagcatagagagacacagatattacaaaacatatcaactaagctagaccgcaccagcactaccggaatatgggtctttaccgagtgctttttatcgcgcactcggcaaagaagactttaccgagcgccgcactcggcaaagtcctgcgctcgataaagagcttgtttaccgagtgcaggacactcggcacaacgaagcactcggcaaagactgctttgccgagcgtcaaacactcgacaaagatggctctcgacaaagggccgttagcagccgtctacagctgacagccgccagtctttgccgaaggccgaaagccggcacttgacaaagccgattctttgccgagtgttaaatatctggcactcggcaaagagagtctttgtcgagtgtcttctgtggacactcgacaaatcatttttttattttttttattttggccaccaaactttttgtggtatgttcctacactatgtagacctacatctaccattttgggacaatttgttggggcgaaggcaaagacgccacccttcgctcgaggccttcgctgcagtcgctggtctgacatagacaaaacgggcagggacacccttcgctcggttcagcaccagacgaaggtctgcgacggcgtcatcccacagtgctgcctcgcccagctcagaggcc

SEQ ID NO: 34 - DNA, 19169 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctatgacttattatgcatcaactcataaagcatagagtgattccacaaaccaaacacaccattagtttattgaccaacctcagttctttgatatataaaagttgtttgatccgtgtgcaacaaatagtttttcaggaatttgggacgtaccccatctcttaaatgtctagactgattggacatattaatctaattttagtagctaagtattagctctcaaacacctcctgggaatgctgccctaaaaatggaatatcggtacgtcggatcggagaaaggttggggtatcgtggtccaaagcatgcgaaagcaacggcgcagggctggaaacctgagaccaggtgaggtgcacgacgacatgcatatggtttgggttaggcctaggagctggttctctctccatgcatggtcagctcgccgcttttgccgccttcgtgtatggcttgccccatgccatgcatcgcgccgtgtacacttgtggcgtaggggcggggccgccgcatcggagcgcccccgtttcggcacggtcctcccagttttagggtaaacccagctagggtagtgggggtaactggccagcgccactccaaatctaccctccttcaatttaaagctgagaaatactgtagtatatactagagtagagcgagagaagggagatgtggatagatgggtggatggggacgcgtgaaaaagatgcgagagagaagagacgaccggacaggcagccacacacagtaacagtagtgaaccctgccccttttcccggtctctccactgatattccgctcctgtccctgtcctccccggacggagctaatagagccggctctgctcatcattatatcgtcgcgcacaaatgcgaagcctagcagcacttgtgtccggcggccttgtgttcgtgggggatgtgtggcatattagctagctgataagcggccggccgaagagcaagcgcagtgagaagaagaagctcggatcggaggaggtcggcaaggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccgggtaggcgatccatccatccatccacacatgcacagcggcctgcgggccgcggtgccactaaattgcttttaattcttagtctctgcaagcagatctgctaggtttttttggcagcaaggaaggaattaaggaaagcacgtagccgagcggtggtgtggtattttattcctgctatctgcgtgtgtatctgcgcgcgcgtaggggcatgggcatggcaatggcatggcggtgttcatacaataaaaaagcaggcgggtggatcccgagttcccgacatcctttcagcggatctacgagccctacgctctgcctctttttcttccagcttctccgggcacttgaaggagttgcccacccacgcacgcacacacacggtacacccctttcctccatcttctccgggtatctggagtggccatctttcgtgtgtgtcgtcgttggagcatgcgcgtgtcagagaaacgccggccggtttgattgctgagctaataggggaatcgtcgtcgtcggggtggaagagggtacgtagagtgggtgttaataacaccgtaccgatgtggtcctccgagaggggaaagggtggtatgttctttccgttttgatccagctcctgcttatatgaaaaccctgctgaccgcttgtcttggcacttgttgttgctcaactgggcctctggccacgcctccatcttatttccagatctctatctctcttgctcgattgctccgcttgttgcttctttcttttttctctttcacgatttcatgcccctttgctcggcaatacgaatttagatttttcattacgttttctctccatacaagatcgatttagatctgcttgagattttcaggagggcctcagcacattttaagtggaaagctcaaagcatgatgaaaatctttctgtttcacgcacccgtactatttctgctttggtatttttgtctttgttctcattttatgcgtctgcatcagtactatactcaaccatgagtggtcgctctttcgcctttattgatagtatgttgctcttgcccgcacttgttggttcatgtatttcacacttcttgctttgtcttcctctgctgcttaaagatcctaacgtacctatttgttcacgtgactggatccagactaataaaactaaacgaagttatttctttcttatttttgtacttccaaaaaaaattccaattcttttgtaacttgaattatgaaaacgatacctttcgttgaatatcgtatattgtgtgtctttaatttgtgtcatggatgtatggatctattttatgattggaagtatatagggagtattgttttgtagtaggaaaatggcctaatcgcctcgaatttaaatcctctgagtttatttctggaaaaaatattttagtttaacgagaagaaagtgctaaattattcaccaccaatttactgcagttctattgcgtcataaaactagtctgctttcatcaagtcatttaccgtgacttcgcagaaccgtttgttcatggtctggtgctctcctaactcccacactatatattgccaataagggggttaatgttcaaaaaataaatcaaagtccaacagggatctggaaatttctgtctccatgtaccactatataatatgcaagcatgcttcataaatttattatttttataatatttgttttaaggcaaaacctagattgaattaaatgacagtttattacagcccctttggcagggctccagtttctctgaaaacaatttcgactctcgctctttggcttctctaaaggagccggagttgttttataattcgtttgaaaaaacagtttttcttatgtttatttcgaatgatgtattagggaaacgaaggaggagccgttagaagccacgtttttggtgctctggctcccaacacaaaaatagctcaacctcttcgaggtctctcaacgaaaagccgttttttaaccgttttgtagggtttcacgatgagcccgagctagagccgcccaaagagccatgccaaagggaccctaaataacacaaagtattcatgtagttcttgtaattcttataggcatatatgcagtataagtgcataattacaagatattcatgaatgttcacaaagtattttcagctttagtggttctaaagatggaagctcccaaatactatgctataaactataaagagttcattccaatctatcacgtgacgagagcacaccctcctacactaatgtggtttacttataatccaaatgcacacgaaatcaggcttcttttatagaaggaatacatttgttatacatatgtatataaaaaaatgaccacccttgcatacaccgatacattcctcagcagcatctttgtcatttaagattatagaagccattttcagcatattttgtagtttcattaaacaagtccatttacatctaactttttgtgcagcgtaactaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattcaaagttatctgcaccgtaattattatatgctccatttgtcccttctggcctaggcgcctattaataaagcatagagagacacagatattacaaaacatatcaactaagctagaccgcaccagcactaccggaatatgggtctttaccgagtgctttttatcgcgcactcggcaaagaagactttaccgagcgccgcactcggcaaagtcctgcgctcgataaagagcttgtttaccgagtgcaggacactcggcacaacgaagcactcggcaaagactgctttgccgagcgtcaaacactcgacaaagatggctctcgacaaagggccgttagcagccgtctacagctgacagccgccagtctttgccgaaggccgaaagccggcacttgacaaagccgattctttgccgagtgttaaatatctggcactcggcaaagagagtctttgtcgagtgtcttctgtggacactcgacaaatcatttttttattttttttattttggccaccaaactttttgtggtatgttcctacactatgtagacctacatctaccattttgggacaatttgttggggcgaaggcaaagacgccacccttcgctcgaggccttcgctgcagtcgctggtctgacatagacaaaacgggcagggacacccttcgctcggttcagcaccagacgaaggtctgcgacggcgtcatcccacagtgctgcctcgcccagctcagaggccggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 35 - DNA, 3634 bp, Artificial Sequence
  derived from Zea mays
acttattatgcatcaactcataaagcatagagtgattccacaaaccaaacacaccattagtttattgaccaacctcagttctttgatatataaaagttgtttgatccgtgtgcaacaaatagtttttcaggaatttgggacgtaccccatctcttaaatgtctagactgattggacatattaatctaattttagtagctaagtattagctctcaaacacctcctgggaatgctgccctaaaaatggaatatcggtacgtcggatcggagaaaggttggggtatcgtggtccaaagcatgcgaaagcaacggcgcagggctggaaacctgagaccaggtgaggtgcacgacgacatgcatatggtttgggttaggcctaggagctggttctctctccatgcatggtcagctcgccgcttttgccgccttcgtgtatggcttgccccatgccatgcatcgcgccgtgtacacttgtggcgtaggggcggggccgccgcatcggagcgcccccgtttcggcacggtcctcccagttttagggtaaacccagctagggtagtgggggtaactggccagcgccactccaaatctaccctccttcaatttaaagctgagaaatactgtagtatatactagagtagagcgagagaagggagatgtggatagatgggtggatggggacgcgtgaaaaagatgcgagagagaagagacgaccggacaggcagccacacacagtaacagtagtgaaccctgccccttttcccggtctctccactgatattccgctcctgtccctgtcctccccggacggagctaatagagccggctctgctcatcattatatcgtcgcgcacaaatgcgaagcctagcagcacttgtgtccggcggccttgtgttcgtgggggatgtgtggcatattagctagctgataagcggccggccgaagagcaagcgcagtgagaagaagaagctcggatcggaggaggtcggcaaggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccgggtaggcgatccatccatccatccacacatgcacagcggcctgcgggccgcggtgccactaaattgcttttaattcttagtctctgcaagcagatctgctaggtttttttggcagcaaggaaggaattaaggaaagcacgtagccgagcggtggtgtggtattttattcctgctatctgcgtgtgtatctgcgcgcgcgtaggggcatgggcatggcaatggcatggcggtgttcatacaataaaaaagcaggcgggtggatcccgagttcccgacatcctttcagcggatctacgagccctacgctctgcctctttttcttccagcttctccgggcacttgaaggagttgcccacccacgcacgcacacacacggtacacccctttcctccatcttctccgggtatctggagtggccatctttcgtgtgtgtcgtcgttggagcatgcgcgtgtcagagaaacgccggccggtttgattgctgagctaataggggaatcgtcgtcgtcggggtggaagagggtacgtagagtgggtgttaataacaccgtaccgatgtggtcctccgagaggggaaagggtggtatgttctttccgttttgatccagctcctgcttatatgaaaaccctgctgaccgcttgtcttggcacttgttgttgctcaactgggcctctggccacgcctccatcttatttccagatctctatctctcttgctcgattgctccgcttgttgcttctttcttttttctctttcacgatttcatgcccctttgctcggcaatacgaatttagatttttcattacgttttctctccatacaagatcgatttagatctgcttgagattttcaggagggcctcagcacattttaagtggaaagctcaaagcatgatgaaaatctttctgtttcacgcacccgtactatttctgctttggtatttttgtctttgttctcattttatgcgtctgcatcagtactatactcaaccatgagtggtcgctctttcgcctttattgatagtatgttgctcttgcccgcacttgttggttcatgtatttcacacttcttgctttgtcttcctctgctgcttaaagatcctaacgtacctatttgttcacgtgactggatccagactaataaaactaaacgaagttatttctttcttatttttgtacttccaaaaaaaattccaattcttttgtaacttgaattatgaaaacgatacctttcgttgaatatcgtatattgtgtgtctttaatttgtgtcatggatgtatggatctattttatgattggaagtatatagggagtattgttttgtagtaggaaaatggcctaatcgcctcgaatttaaatcctctgagtttatttctggaaaaaatattttagtttaacgagaagaaagtgctaaattattcaccaccaatttactgcagttctattgcgtcataaaactagtctgctttcatcaagtcatttaccgtgacttcgcagaaccgtttgttcatggtctggtgctctcctaactcccacactatatattgccaataagggggttaatgttcaaaaaataaatcaaagtccaacagggatctggaaatttctgtctccatgtaccactatataatatgcaagcatgcttcataaatttattatttttataatatttgttttaaggcaaaacctagattgaattaaatgacagtttattacagcccctttggcagggctccagtttctctgaaaacaatttcgactctcgctctttggcttctctaaaggagccggagttgttttataattcgtttgaaaaaacagtttttcttatgtttatttcgaatgatgtattagggaaacgaaggaggagccgttagaagccacgtttttggtgctctggctcccaacacaaaaatagctcaacctcttcgaggtctctcaacgaaaagccgttttttaaccgttttgtagggtttcacgatgagcccgagctagagccgcccaaagagccatgccaaagggaccctaaataacacaaagtattcatgtagttcttgtaattcttataggcatatatgcagtataagtgcataattacaagatattcatgaatgttcacaaagtattttcagctttagtggttctaaagatggaagctcccaaatactatgctataaactataaagagttcattccaatctatcacgtgacgagagcacaccctcctacactaatgtggtttacttataatccaaatgcacacgaaatcaggcttcttttatagaaggaatacatttgttatacatatgtatataaaaaaatgaccacccttgcatacaccgatacattcctcagcagcatctttgtcatttaagattatagaagccattttcagcatattttgtagtttcattaaacaagtccatttacatctaactttttgtgcagcgtaactaaaacttt

SEQ ID NO: 36 - DNA, 1000 bp, Artificial Sequence; identical to SEQ ID NO: 33
  derived from Zea mays

SEQ ID NO: 37 - DNA, 17524 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccaataatttgtcttgtgtacaatattccaatcctctaatccatattcggtgtttggtttttccgactaaatcttagtctgggtatttaaatatcaattagagcatctccaacaaaaaaaaactatatttaagttttaagatttgaatagaatctgatttaaattgtttagagccataaaaacatttgcacctccaataccaatagttgacttctatatcatattattaggaaatagatcatgtcatttagtaaacaaaatgttaaaaatggtatacaaaacgaggatagggttccagcatatgtggtccaatattttttgtgaaataccaggtcctataattgtttgatgattttttgtgaaataggacttttgttggagcagattttttgtgttggagtcctacatttcaaattaagaccccatttatgactcccgttgaagatgctcttacaagtactaaatataattcaattacaaaactaattacatagattaaagaccaagaaaaatttatgaagcctaattaatatatacttagaattgtttacggtagcgaatcatggattaattgggtttaatatatttgtcttgttgtttagttctcatctgtacggttagttttataattagactatatttaatacttttaaatagcattcaaatatatttgatatgacaataattaatatttagtagttgtatctaaaaattcgttgtgaaaaagcgaaaaaaaaatcattgtgattttgtttattatcaaatatactttacatatggcttaattttttaaattttctcatgatttttttgaattagatgagtggtcaaattgaagttgaaaaaatcaaacgaattatattttaagacagatgaagtaactattaggacatagttgtcatgcccgggtgacactgctgggctgctggctggtgtacctgcattatcaacctcaaaaaatacttagctagactgaccgaagtcttttcttcaataacggaaaacagcgttccgagtcttccgacctatgcccctttggaacgcagacgtttctttctttctgttttctactctttttttcaagtgaaaaataattaattcacgtgatattcctataactgcgttcaaaaaggcaccggccacttctgtctgtttcaagtggctctatacgcttgtagccagtaagttctgtgatcactttgctcagccacaaacgctgcttccgctagagtagacaacaaaaaggaattaaatacacggaagcttgtaagagtatgtcacgtaggcggccagcatagcatgtactcttatgtttatttttctctttagggattttcattttcgaaagagaaattagttcattttttttataaaatttctttagaaattaaggtttctaaactagctctaaaaatagaaccccccccccttttgtctttcctgcgtctccttcctttgctattgcagaagttcacatggctgatgcctcatgaagtagcatcatcgatgcccatgattttttttaaggggaagtaaattttaaaggctaaatataaaaatacatggcacgctagcagctagcaggcgctatcaataagaaatgttcatgtgtttgatatagatatacgtggtacaccacataaagaagtttagaaatacaaaaaaaatatgtttacaaagtttaaatgaccgtcggtctattgagctcatacaaaaaaatacagtggaaaagagaattcactgcacattactcttttttttttttttgaaaatcaccgtggggtttgctgcactacctctatataaggcgcggtggtgcacgccgtgttcaacactagaactaactcatctcttcctctccattgcattttcttcttcctccaaatacgtaacaaacttctacgtgagcgccagggcagttgcgcccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaaattatcctttgcctgctgaacggacgatgcattgttctatagtgaaagacttgagtgtgctctgagtctctgactgacatctggagaaggatggcatctgcaatagtcgccgtgttctttttagtacactagaataaatggatgttttttgtggacgcccatgttgaactagttttcttttccagtaagtacttcagaatgagtgagataaatatatcattcagcgtctggtggtctggcattggaattcaaccagcatggcctgccttgttatccacctgattggttacccgcatcattttgatgctattaacattcacccaccatacgttcaaaattatcgtatctgactggcctagacagcaccagcatgtgcatgaacgtgcggtcatccaatcatgttatgtgtttcgggcttgtggctctatggcacagcttagagtttcctcaaccaagagagaatgggaggttggtaacttcaagttctatccaaatccaacctggattaaactctgttgctgcaaaaattcaaggcagggcaatactatccgatcgtcctgccaaagtgcaagtgtatgaatctgccatcacgaagcctgtcagtcgtcttcatcgtccaaaacaaagcctcaagcctcgcataaaagatcctaacaagaatcctaacaagaaatgctccggtccagagacgacgagccgatggcccgatgctcagaagattgtgagggtccggtccacagcaagtaagaagcttgtgcatgcccatgcggccatgctgccaaaccataacaggccagggtcagggtgcaccgtgcacgaatcgacggtcctggattcagcatcactctcctgcagatggcgcagccaaagtttccctggtttagctggactttggtccgagatcaaacgctagtcaactaacctgagcagggacaggtaaagtgtctcgcaaatcatagtcgaaaaataatagaaaggaacacttttacgattttcccccctttttcagaaaatggttacagtgacttttttaaaaggtaaaggcctctgattaacctgacagagattgtgtacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 38 - DNA, 1920 bp, Artificial sequence
  derived from Zea mays
tttgtcttgtgtacaatattccaatcctctaatccatattcggtgtttggtttttccgactaaatcttagtctgggtatttaaatatcaattagagcatctccaacaaaaaaaaactatatttaagttttaagatttgaatagaatctgatttaaattgtttagagccataaaaacatttgcacctccaataccaatagttgacttctatatcatattattaggaaatagatcatgtcatttagtaaacaaaatgttaaaaatggtatacaaaacgaggatagggttccagcatatgtggtccaatattttttgtgaaataccaggtcctataattgtttgatgattttttgtgaaataggacttttgttggagcagattttttgtgttggagtcctacatttcaaattaagaccccatttatgactcccgttgaagatgctcttacaagtactaaatataattcaattacaaaactaattacatagattaaagaccaagaaaaatttatgaagcctaattaatatatacttagaattgtttacggtagcgaatcatggattaattgggtttaatatatttgtcttgttgtttagttctcatctgtacggttagttttataattagactatatttaatacttttaaatagcattcaaatatatttgatatgacaataattaatatttagtagttgtatctaaaaattcgttgtgaaaaagcgaaaaaaaaatcattgtgattttgtttattatcaaatatactttacatatggcttaattttttaaattttctcatgatttttttgaattagatgagtggtcaaattgaagttgaaaaaatcaaacgaattatattttaagacagatgaagtaactattaggacatagttgtcatgcccgggtgacactgctgggctgctggctggtgtacctgcattatcaacctcaaaaaatacttagctagactgaccgaagtcttttcttcaataacggaaaacagcgttccgagtcttccgacctatgcccctttggaacgcagacgtttctttctttctgttttctactctttttttcaagtgaaaaataattaattcacgtgatattcctataactgcgttcaaaaaggcaccggccacttctgtctgtttcaagtggctctatacgcttgtagccagtaagttctgtgatcactttgctcagccacaaacgctgcttccgctagagtagacaacaaaaaggaattaaatacacggaagcttgtaagagtatgtcacgtaggcggccagcatagcatgtactcttatgtttatttttctctttagggattttcattttcgaaagagaaattagttcattttttttataaaatttctttagaaattaaggtttctaaactagctctaaaaatagaaccccccccccttttgtctttcctgcgtctccttcctttgctattgcagaagttcacatggctgatgcctcatgaagtagcatcatcgatgcccatgattttttttaaggggaagtaaattttaaaggctaaatataaaaatacatggcacgctagcagctagcaggcgctatcaataagaaatgttcatgtgtttgatatagatatacgtggtacaccacataaagaagtttagaaatacaaaaaaaatatgtttacaaagtttaaatgaccgtcggtctattgagctcatacaaaaaaatacagtggaaaagagaattcactgcacattactcttttttttttttttgaaaatcaccgtggggtttgctgcactacctctatataaggcgcggtggtgcacgccgtgttcaacactagaactaactcatctcttcctctccattgcattttcttcttcctccaaatacgtaacaaacttctacgtgagcgccagggcagttgcgccc

SEQ ID NO: 39 - DNA, 1069 bp, Artificial Sequence
  derived from Zea mays
tcctttgcctgctgaacggacgatgcattgttctatagtgaaagacttgagtgtgctctgagtctctgactgacatctggagaaggatggcatctgcaatagtcgccgtgttctttttagtacactagaataaatggatgttttttgtggacgcccatgttgaactagttttcttttccagtaagtacttcagaatgagtgagataaatatatcattcagcgtctggtggtctggcattggaattcaaccagcatggcctgccttgttatccacctgattggttacccgcatcattttgatgctattaacattcacccaccatacgttcaaaattatcgtatctgactggcctagacagcaccagcatgtgcatgaacgtgcggtcatccaatcatgttatgtgtttcgggcttgtggctctatggcacagcttagagtttcctcaaccaagagagaatgggaggttggtaacttcaagttctatccaaatccaacctggattaaactctgttgctgcaaaaattcaaggcagggcaatactatccgatcgtcctgccaaagtgcaagtgtatgaatctgccatcacgaagcctgtcagtcgtcttcatcgtccaaaacaaagcctcaagcctcgcataaaagatcctaacaagaatcctaacaagaaatgctccggtccagagacgacgagccgatggcccgatgctcagaagattgtgagggtccggtccacagcaagtaagaagcttgtgcatgcccatgcggccatgctgccaaaccataacaggccagggtcagggtgcaccgtgcacgaatcgacggtcctggattcagcatcactctcctgcagatggcgcagccaaagtttccctggtttagctggactttggtccgagatcaaacgctagtcaactaacctgagcagggacaggtaaagtgtctcgcaaatcatagtcgaaaaataatagaaaggaacacttttacgattttcccccctttttcagaaaatggttacagtgacttttttaaaaggtaaaggcctctgattaacctgacagagattgtgta

SEQ ID NO: 40 - DNA, 17535 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttaccttgttttcttttgttgatttccttctgtaagacagtaagagccaattagagaaggaatatatagttcatcaagtttcatgttactttttgattcactggttttgcactcattaatcttcatcttgaaagacaggtggtgatgtgctcgtgacgtctcttgtgcccacttatgtcaataggcatatatatatacatctgggctccagacaattagccacctggctcggtcaagcggacatcccgaggtcaagatagtcgtttgagagaaaacagtgtgacgcaggtcagacggacatcccgaggtcaaaagagccgtttgagaggaaacgttgtgacgcgcgagaggtgcaccaggcacacggtcgttgagcccacaaggacttaatgcgtgggaggagacgccatgatagatgcattttgcggcccgttcgtagaaagaggctataccatatatggtataccatgaaaaaaaatgttataaattacacgtcgtataatcataatatactataacatatctagatttattctatctttgtagttgtttgctccctatgaaatactagcaaaatattaatatttagaaagtagagaatattgttatacatattaacttgaaaaacaatatcacatggtcaatctcaatagtgaagcgttaatctccctagtttcatgttctatctatgtctatgattaccttgttttcttttgttgatttcctttcataagacagtaagagccaattagagaaggaataatccatcaagtttcatgttactttttaattcactgattttgcactcattaatcttcatctgaaagacaggtggtgataatctcgtgacgtctcttgtgcccacttatctcaataggcatatatatgcctgtgctccagacaaatggccacctggctcagtcaagcggacatcccgaggccaaaagagttgtttgagagaaaacattatgacacgggtctgacgagcatcccgaggtcaaaaaaaagccatttgagagaaaacattgtgagcgtgagaggtgcaccaggcacacggtcgttgggtccacaagcacttaacgcgtaggaggagacgtcatggtagatgagtgttgcatatcccgtttgtaaaaagagactataccatagatggtataccacaaatcaaaatgttacgagaattgcacatcttataatcacaatgtactataatatatcgagatatattctttcttttagccgtttgctccatataaatacaagcaaaaaaaactaaataatatttagaagtagaggagattgttactatattttaacttgaacaacaatactccctccatttcgaaatgtttgacaccgttaactttttagcacgtatttgaccgttcgtcttattcaaaaacttttgtgaaatatgtaaaattatatacctacataaaaatatatttaacaatgaatcaaatgataggaaaagaattaataattacttaatttttttaataaaacgaacggtcaaacatgtttaaaaaagtcaacggcgtcaaacatttcgaaacggagggagtatatcacaagatcaataagccttaatctccctagttcgatgttctatatagacagttctatgattcccttcttttctttggttgatttctttctgtatttccgttagacggtagtaagagccacaatgctatggctgcaaccgctcaattcgccgctcatccgcaatcagcgcgcccgcgccgcccactcactcacagccggatgggcccgatcatccggcgcgagagtgggtcccacctgtcagtgagtgccaccaaaagcgggccgatcctttccaaaaatccctcgtgggaccctcggcttgacccgccccggctataaatagccccgcctctctcctctccttgtctcatcaaccctctctctctctctctctctgcctcggcgacctcgcctccgcttactctcccacccagacaaaaccctctttgcctctctaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgctactcgatagttgtatgtttctcgaagtgtatttttttggggttatgtgtgatgtttgaaagacaggtcatgatctaaattatttctgcggattagttgacatgccatgatctaaattttttgtagttggcttcgataagttgattttcaccacacacacacacacattcactttttttgaacgacacacacacattcacatatgtgtgtgcgtgtatatgtatatgtcgtttagcgctcacttgaatggtggttttataggacaatatgcaagtttacttgatcccttttgaaccattaaggactcgttgggcttttttaggaaaaacaaagcaaacaaattcctaagaattaatcgccataggtgtcattcggtttgtaggaataaactatatgagaaacgaaagaaaattttccgcttgcaagttataaagagaatacactgaaaaatttacatccattcaaatctcttgaaaaataattagtgtgtgcatttatttctattcctatagattaaaattcctttcaatagaataagctctaaatgcatggataatctagcagatggacagtttaacgccatgtggccttgactatcaaggcttcttctactatctctatcttaaaataagttcatttgcgggtttctatgtttaacatttaaccattcgttttatttaaaaaaattattaaaaaaaataaaaataagttaagtataaaatactattcatgttctatatcatataataacaataaaaatactaattataaaaaattttaaatagaacggacaatcaaaggttggataaaaaactcataaataaacttattttcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 41 - DNA, 2000 bp, Artificial Sequence
  Oryza sativa derived
ccttgttttcttttgttgatttccttctgtaagacagtaagagccaattagagaaggaatatatagttcatcaagtttcatgttactttttgattcactggttttgcactcattaatcttcatcttgaaagacaggtggtgatgtgctcgtgacgtctcttgtgcccacttatgtcaataggcatatatatatacatctgggctccagacaattagccacctggctcggtcaagcggacatcccgaggtcaagatagtcgtttgagagaaaacagtgtgacgcaggtcagacggacatcccgaggtcaaaagagccgtttgagaggaaacgttgtgacgcgcgagaggtgcaccaggcacacggtcgttgagcccacaaggacttaatgcgtgggaggagacgccatgatagatgcattttgcggcccgttcgtagaaagaggctataccatatatggtataccatgaaaaaaaatgttataaattacacgtcgtataatcataatatactataacatatctagatttattctatctttgtagttgtttgctccctatgaaatactagcaaaatattaatatttagaaagtagagaatattgttatacatattaacttgaaaaacaatatcacatggtcaatctcaatagtgaagcgttaatctccctagtttcatgttctatctatgtctatgattaccttgttttcttttgttgatttcctttcataagacagtaagagccaattagagaaggaataatccatcaagtttcatgttactttttaattcactgattttgcactcattaatcttcatctgaaagacaggtggtgataatctcgtgacgtctcttgtgcccacttatctcaataggcatatatatgcctgtgctccagacaaatggccacctggctcagtcaagcggacatcccgaggccaaaagagttgtttgagagaaaacattatgacacgggtctgacgagcatcccgaggtcaaaaaaaagccatttgagagaaaacattgtgagcgtgagaggtgcaccaggcacacggtcgttgggtccacaagcacttaacgcgtaggaggagacgtcatggtagatgagtgttgcatatcccgtttgtaaaaagagactataccatagatggtataccacaaatcaaaatgttacgagaattgcacatcttataatcacaatgtactataatatatcgagatatattctttcttttagccgtttgctccatataaatacaagcaaaaaaaactaaataatatttagaagtagaggagattgttactatattttaacttgaacaacaatactccctccatttcgaaatgtttgacaccgttaactttttagcacgtatttgaccgttcgtcttattcaaaaacttttgtgaaatatgtaaaattatatacctacataaaaatatatttaacaatgaatcaaatgataggaaaagaattaataattacttaatttttttaataaaacgaacggtcaaacatgtttaaaaaagtcaacggcgtcaaacatttcgaaacggagggagtatatcacaagatcaataagccttaatctccctagttcgatgttctatatagacagttctatgattcccttcttttctttggttgatttctttctgtatttccgttagacggtagtaagagccacaatgctatggctgcaaccgctcaattcgccgctcatccgcaatcagcgcgcccgcgccgcccactcactcacagccggatgggcccgatcatccggcgcgagagtgggtcccacctgtcagtgagtgccaccaaaagcgggccgatcctttccaaaaatccctcgtgggaccctcggcttgacccgccccggctataaatagccccgcctctctcctctccttgtctcatcaaccctctctctctctctctctctgcctcggcgacctcgcctccgcttactctcccacccagacaaaaccctctttgcctctc

SEQ ID NO: 42 - DNA, 1000 bp, Artificial Sequence
  Oryza sativa derived
tcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgctactcgatagttgtatgtttctcgaagtgtatttttttggggttatgtgtgatgtttgaaagacaggtcatgatctaaattatttctgcggattagttgacatgccatgatctaaattttttgtagttggcttcgataagttgattttcaccacacacacacacacattcactttttttgaacgacacacacacattcacatatgtgtgtgcgtgtatatgtatatgtcgtttagcgctcacttgaatggtggttttataggacaatatgcaagtttacttgatcccttttgaaccattaaggactcgttgggcttttttaggaaaaacaaagcaaacaaattcctaagaattaatcgccataggtgtcattcggtttgtaggaataaactatatgagaaacgaaagaaaattttccgcttgcaagttataaagagaatacactgaaaaatttacatccattcaaatctcttgaaaaataattagtgtgtgcatttatttctattcctatagattaaaattcctttcaatagaataagctctaaatgcatggataatctagcagatggacagtttaacgccatgtggccttgactatcaaggcttcttctactatctctatcttaaaataagttcatttgcgggtttctatgtttaacatttaaccattcgttttatttaaaaaaattattaaaaaaaataaaaataagttaagtataaaatactattcatgttctatatcatataataacaataaaaatactaattataaaaaattttaaatagaacggacaatcaaaggttggataaaaaactcataaataaacttatttt

SEQ ID NO: 43 - DNA, 20371 bp, Artificial sequence
  vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttgttttcttttgttgatttccttctgtaagacagtaagagccaattagagaaggaatatatagttcatcaagtttcatgttactttttgattcactggttttgcactcattaatcttcatcttgaaagacaggtggtgatgtgctcgtgacgtctcttgtgcccacttatgtcaataggcatatatatatacatctgggctccagacaattagccacctggctcggtcaagcggacatcccgaggtcaagatagtcgtttgagagaaaacagtgtgacgcaggtcagacggacatcccgaggtcaaaagagccgtttgagaggaaacgttgtgacgcgcgagaggtgcaccaggcacacggtcgttgagcccacaaggacttaatgcgtgggaggagacgccatgatagatgcattttgcggcccgttcgtagaaagaggctataccatatatggtataccatgaaaaaaaatgttataaattacacgtcgtataatcataatatactataacatatctagatttattctatctttgtagttgtttgctccctatgaaatactagcaaaatattaatatttagaaagtagagaatattgttatacatattaacttgaaaaacaatatcacatggtcaatctcaatagtgaagcgttaatctccctagtttcatgttctatctatgtctatgattaccttgttttcttttgttgatttcctttcataagacagtaagagccaattagagaaggaataatccatcaagtttcatgttactttttaattcactgattttgcactcattaatcttcatctgaaagacaggtggtgataatctcgtgacgtctcttgtgcccacttatctcaataggcatatatatgcctgtgctccagacaaatggccacctggctcagtcaagcggacatcccgaggccaaaagagttgtttgagagaaaacattatgacacgggtctgacgagcatcccgaggtcaaaaaaaagccatttgagagaaaacattgtgagcgtgagaggtgcaccaggcacacggtcgttgggtccacaagcacttaacgcgtaggaggagacgtcatggtagatgagtgttgcatatcccgtttgtaaaaagagactataccatagatggtataccacaaatcaaaatgttacgagaattgcacatcttataatcacaatgtactataatatatcgagatatattctttcttttagccgtttgctccatataaatacaagcaaaaaaaactaaataatatttagaagtagaggagattgttactatattttaacttgaacaacaatactccctccatttcgaaatgtttgacaccgttaactttttagcacgtatttgaccgttcgtcttattcaaaaacttttgtgaaatatgtaaaattatatacctacataaaaatatatttaacaatgaatcaaatgataggaaaagaattaataattacttaatttttttaataaaacgaacggtcaaacatgtttaaaaaagtcaacggcgtcaaacatttcgaaacggagggagtatatcacaagatcaataagccttaatctccctagttcgatgttctatatagacagttctatgattcccttcttttctttggttgatttctttctgtatttccgttagacggtagtaagagccacaatgctatggctgcaaccgctcaattcgccgctcatccgcaatcagcgcgcccgcgccgcccactcactcacagccggatgggcccgatcatccggcgcgagagtgggtcccacctgtcagtgagtgccaccaaaagcgggccgatcctttccaaaaatccctcgtgggaccctcggcttgacccgccccggctataaatagccccgcctctctcctctccttgtctcatcaaccctctctctctctctctctctgcctcggcgacctcgcctccgcttactctcccacccagacaaaaccctctttgcctctcttggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagaaggcgttcgccctgctaaggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtaagcctcccctagctacattaaccctactcgttcttccagttcccctttcatttcgctttcgttgcgattatatctctagtaaatcgctttcatccctcgtagactagtagaataaattcgttgcgatgcgattcacgaatcgatcaagcgattcgtatacttctagcagtattagattacagtgtactggagtactacatctggtggagtattattttttatcttcatcatcttctcattctttttttttttacctttatcttgtatacacgcggtagttttcgggttgccgttttgggcgaaagctccgcagaggggccatgtgccgtgcttgcttcattttcggtatccatcatcaactcagctctcgcggctaaatcgtggctttagacctttagtacttcggtctctcgctgttgctcggttttgttgttatcaccacatctctgtctgaatccttaggtagtagcctcgtgcatctgtgcagagttgatctggttgctgattgaggaaaagggtcttggtccactgtgtggttgcctggttgatgagatcttagtagagttcctgtgtctttcatctttgctatttgtgccctgaagtaggggtttgggtggtgtgcatgtggtggaagaagggggatcttcgggtttagagggatgaccgaggcggcgcagcctcagccgcatgggagaaggagaacggtgatttgatgttggtggcgaggaatctcatcggactagctaggagaggtgagggaaatggtagaggagaggcatgtaggggtatcggtggcaaacttgaggtagacgataatagtggcggcggaatctgacggagaactcgtggggtttgaggaaggtagggtaggggtggcggcgcgcggggatgaggggagggagtgagaggggggatattagggttagaaatgcacgaatcttcgggcaatcttagccatccaaaaaagtgattgacatttagcatataccccctttgtcctaaaataaatcaatatccctcgcatcctgaggagaacaaaagacctaaatacccctcattattgggtgggaacatttaatgtgaaaaaaagacaaaatacccctcgttaatagaaaaattgtattggtgagtgggaatatttagtgagaataaaagatcaaaataccccctcgttaataagaaagttggattagtgggggtggaggtggcggcgtgaggggtacgagggagggagggtgggggtgacggcgcgcggggtataaggggattgagtgagatggaggattagggttagattattatagagcccacacgaatctttgagcaatcttaaccatgggaaaaagtgattgacatttagcatataccccttttgtcctaaaataaaccaatatccctcacatcttgaggaacacttagtgagaacaacagatcaaaatacctctcgtgaatagcaaacttgtattggtgggtaggaacatttaatgagaacaaaagaccaaaatgtccctcatttgtagaaaagttgtattggtgagtgggaacatttagtgacaataaaagaccaaaatgtccctcattaaaaagaaaattggattagtgagtagaaagtgaaagattgaaaggatgaaacttgtcaatttatggactgagaacaggtaagagcaagtacaaatactacgctagctactagctattagaaataccatgctagccttgatgccgagctggaggtgaacaatgtgatgagagagagtaagtgggtcaaaaaggttgtagcttgtactattgttgtagcatgcaacgagcatgagttaaatgcgtttcttagagtgatggccccactctgctctgggacctagccggtcgcacaacccgcctaggcccagagccagccctgacatgtataataggttagctatggttagctcaaatttttccctactccctttttctctcactatgaatttaacacatatcttgaaacatgtgtagatctagcttttgtatgagaacaaacacttgttacttttgtttgtctctcttttaggtaagttttatagttggtttataactcattgttagcgatcctagtcgttcctatcctttttgacgattagactgcatgcatcttttttttttcaggtgagtttgagtccctaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgctactcgatagttgtatgtttctcgaagtgtatttttttggggttatgtgtgatgtttgaaagacaggtcatgatctaaattatttctgcggattagttgacatgccatgatctaaattttttgtagttggcttcgataagttgattttcaccacacacacacacacattcactttttttgaacgacacacacacattcacatatgtgtgtgcgtgtatatgtatatgtcgtttagcgctcacttgaatggtggttttataggacaatatgcaagtttacttgatcccttttgaaccattaaggactcgttgggcttttttaggaaaaacaaagcaaacaaattcctaagaattaatcgccataggtgtcattcggtttgtaggaataaactatatgagaaacgaaagaaaattttccgcttgcaagttataaagagaatacactgaaaaatttacatccattcaaatctcttgaaaaataattagtgtgtgcatttatttctattcctatagattaaaattcctttcaatagaataagctctaaatgcatggataatctagcagatggacagtttaacgccatgtggccttgactatcaaggcttcttctactatctctatcttaaaataagttcatttgcgggtttctatgtttaacatttaaccattcgttttatttaaaaaaattattaaaaaaaataaaaataagttaagtataaaatactattcatgttctatatcatataataacaataaaaatactaattataaaaaattttaaatagaacggacaatcaaaggttggataaaaaactcataaataaacttattttcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 44 - DNA, 4841 bp, Artificial Sequence
  Oryza sativa derived
ccttgttttcttttgttgatttccttctgtaagacagtaagagccaattagagaaggaatatatagttcatcaagtttcatgttactttttgattcactggttttgcactcattaatcttcatcttgaaagacaggtggtgatgtgctcgtgacgtctcttgtgcccacttatgtcaataggcatatatatatacatctgggctccagacaattagccacctggctcggtcaagcggacatcccgaggtcaagatagtcgtttgagagaaaacagtgtgacgcaggtcagacggacatcccgaggtcaaaagagccgtttgagaggaaacgttgtgacgcgcgagaggtgcaccaggcacacggtcgttgagcccacaaggacttaatgcgtgggaggagacgccatgatagatgcattttgcggcccgttcgtagaaagaggctataccatatatggtataccatgaaaaaaaatgttataaattacacgtcgtataatcataatatactataacatatctagatttattctatctttgtagttgtttgctccctatgaaatactagcaaaatattaatatttagaaagtagagaatattgttatacatattaacttgaaaaacaatatcacatggtcaatctcaatagtgaagcgttaatctccctagtttcatgttctatctatgtctatgattaccttgttttcttttgttgatttcctttcataagacagtaagagccaattagagaaggaataatccatcaagtttcatgttactttttaattcactgattttgcactcattaatcttcatctgaaagacaggtggtgataatctcgtgacgtctcttgtgcccacttatctcaataggcatatatatgcctgtgctccagacaaatggccacctggctcagtcaagcggacatcccgaggccaaaagagttgtttgagagaaaacattatgacacgggtctgacgagcatcccgaggtcaaaaaaaagccatttgagagaaaacattgtgagcgtgagaggtgcaccaggcacacggtcgttgggtccacaagcacttaacgcgtaggaggagacgtcatggtagatgagtgttgcatatcccgtttgtaaaaagagactataccatagatggtataccacaaatcaaaatgttacgagaattgcacatcttataatcacaatgtactataatatatcgagatatattctttcttttagccgtttgctccatataaatacaagcaaaaaaaactaaataatatttagaagtagaggagattgttactatattttaacttgaacaacaatactccctccatttcgaaatgtttgacaccgttaactttttagcacgtatttgaccgttcgtcttattcaaaaacttttgtgaaatatgtaaaattatatacctacataaaaatatatttaacaatgaatcaaatgataggaaaagaattaataattacttaatttttttaataaaacgaacggtcaaacatgtttaaaaaagtcaacggcgtcaaacatttcgaaacggagggagtatatcacaagatcaataagccttaatctccctagttcgatgttctatatagacagttctatgattcccttcttttctttggttgatttctttctgtatttccgttagacggtagtaagagccacaatgctatggctgcaaccgctcaattcgccgctcatccgcaatcagcgcgcccgcgccgcccactcactcacagccggatgggcccgatcatccggcgcgagagtgggtcccacctgtcagtgagtgccaccaaaagcgggccgatcctttccaaaaatccctcgtgggaccctcggcttgacccgccccggctataaatagccccgcctctctcctctccttgtctcatcaaccctctctctctctctctctctgcctcggcgacctcgcctccgcttactctcccacccagacaaaaccctctttgcctctcttggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagaaggcgttcgccctgctaaggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtaagcctcccctagctacattaaccctactcgttcttccagttcccctttcatttcgctttcgttgcgattatatctctagtaaatcgctttcatccctcgtagactagtagaataaattcgttgcgatgcgattcacgaatcgatcaagcgattcgtatacttctagcagtattagattacagtgtactggagtactacatctggtggagtattattttttatcttcatcatcttctcattctttttttttttacctttatcttgtatacacgcggtagttttcgggttgccgttttgggcgaaagctccgcagaggggccatgtgccgtgcttgcttcattttcggtatccatcatcaactcagctctcgcggctaaatcgtggctttagacctttagtacttcggtctctcgctgttgctcggttttgttgttatcaccacatctctgtctgaatccttaggtagtagcctcgtgcatctgtgcagagttgatctggttgctgattgaggaaaagggtcttggtccactgtgtggttgcctggttgatgagatcttagtagagttcctgtgtctttcatctttgctatttgtgccctgaagtaggggtttgggtggtgtgcatgtggtggaagaagggggatcttcgggtttagagggatgaccgaggcggcgcagcctcagccgcatgggagaaggagaacggtgatttgatgttggtggcgaggaatctcatcggactagctaggagaggtgagggaaatggtagaggagaggcatgtaggggtatcggtggcaaacttgaggtagacgataatagtggcggcggaatctgacggagaactcgtggggtttgaggaaggtagggtaggggtggcggcgcgcggggatgaggggagggagtgagaggggggatattagggttagaaatgcacgaatcttcgggcaatcttagccatccaaaaaagtgattgacatttagcatataccccctttgtcctaaaataaatcaatatccctcgcatcctgaggagaacaaaagacctaaatacccctcattattgggtgggaacatttaatgtgaaaaaaagacaaaatacccctcgttaatagaaaaattgtattggtgagtgggaatatttagtgagaataaaagatcaaaataccccctcgttaataagaaagttggattagtgggggtggaggtggcggcgtgaggggtacgagggagggagggtgggggtgacggcgcgcggggtataaggggattgagtgagatggaggattagggttagattattatagagcccacacgaatctttgagcaatcttaaccatgggaaaaagtgattgacatttagcatataccccttttgtcctaaaataaaccaatatccctcacatcttgaggaacacttagtgagaacaacagatcaaaatacctctcgtgaatagcaaacttgtattggtgggtaggaacatttaatgagaacaaaagaccaaaatgtccctcatttgtagaaaagttgtattggtgagtgggaacatttagtgacaataaaagaccaaaatgtccctcattaaaaagaaaattggattagtgagtagaaagtgaaagattgaaaggatgaaacttgtcaatttatggactgagaacaggtaagagcaagtacaaatactacgctagctactagctattagaaataccatgctagccttgatgccgagctggaggtgaacaatgtgatgagagagagtaagtgggtcaaaaaggttgtagcttgtactattgttgtagcatgcaacgagcatgagttaaatgcgtttcttagagtgatggccccactctgctctgggacctagccggtcgcacaacccgcctaggcccagagccagccctgacatgtataataggttagctatggttagctcaaatttttccctactccctttttctctcactatgaatttaacacatatcttgaaacatgtgtagatctagcttttgtatgagaacaaacacttgttacttttgtttgtctctcttttaggtaagttttatagttggtttataactcattgttagcgatcctagtcgttcctatcctttttgacgattagactgcatgcatcttttttttttcaggtgagtttgagtccc

SEQ ID NO: 45 - DNA, 1000 bp, Artificial Sequence; identical to SEQ ID NO: 42
  Oryza sativa derived

SEQ ID NO: 46 - DNA, 17678 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttagacgtctgtgtttgtaatcttcgctgctctattcaaaggaagggtggccggacccatccatagggctggtttgactcaattcacttagttttgtctccgctgaaattttgagtcgagtttgttcttgtgttcttcctttctctctctttatgaatttgtgaagaaccatcgagttcttgagttggtgattcatttggagattgttaggtgctttgatacactctttggatcactacatacatcccttggtgcatttcttagtcgtgatccaagttgatctcagtttgagtttgtttaagaaaaccctaacaaaacctcaattctgaccgtattttcatatctgcgattgattcacaaatttgattgagttcaacatttgtggagaccttggaaatacatttttcaaggtgtatgtaaaattttagctcaatcacggtcggttttgtttagtttcgcattcactgaattttgagctgctgaaatcagcacaagatagcgacacagttttgggccgattcggacttttctgtgcctgaagtgctatcctttcattttactgatctcgtgtgagtcttagaaacattttaaaaatcataagatcactggtttgctgatgtgcttttggtttgaacgtttttttatctcaattgaaatgaagtgctcaatttcagctttaagcatcaaaaatttaattgactcctattcacctttctgatcggctcaacgatcctttaatgacttatgagtactttctctgtttaaaattataaaatattttattttttaaaagtttaaatatctcaaatttatccaaaattataatgttctaatctgaagttgattttgggatggccgagtccaaatcattaaatgctagtttgggacagagaacatgtagctagagagaagtgattgaaaggtttgctatacctattttagaatatatgttttgaataggaaattttgtgaactttaatatagaggcttaaaagaaatacttaactcgtgactgcaatatgagataggatgtggaatatctagagatatattcatactgatagcgaacaggtgtggcaagggttttgtgatttggtgatgcatcgtaactgatgatttgtatagttcctttagtcatttgactaaattttagtgactaaaattatgtttggttttattgattaaatctgactaaggaacattaagtactatacataaagaccgtcttacccctatttaatagggcatagggaagaagggagggcatatactgtcacttttaccccttgctgatgaaaggactaaattttagttggagtgatttagactctgtttgggagagcttcattttaagaattacaacttcgattttctagcttcaccatgaaacgccttcaacagattggtaaggcagagttcaagagtgtttggcttgcacatagactacaacatctgtaatataattaatttgtgcgaatttcctgaattacccttgatgattagtgggtgaagaaagagacatgaatcggtaggtcatgtaaccaatggtatgctggataatttttgtataagtttatgaggatgtatgaaaataatgtttttgaagcatcatgtgaggagcttcgaaaatttcatgaaactggcctctagtttcaatttttttaattagagtttgtggagctagacctatttggaaacatcaaagctgaaatagacctgaaattaaaaaggtctcccaaacatgacattagttattatatttggttctttagtgactaaaagtgactttagcaccctaaaccaaacaggcctgaatcgtactccctctttcattttcccaacacctaaacaacgtaaagtttgattttaaataaataagaaatactgttatttatgatatatttaaaatattgtaagattaataatataatatttttatataagatataaatagtgctgttttttgtctagaaaaactagatgtgattttttttgacgtagagtactacaaaatcaggggcaattaaggacgttataacagccaagccgaactcttttgtgagctcaaaggccaagacccaacaaccaaacatcacctgcacaccacttgtcttgacacaccacacacaagaattgtatcaccgctgccagctaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctagcgagagctagacagtccaatatgccagttacatacttacattgcacacgtacatcaaacgaataaatgtcaagctattctaaattttaatactactgcaatggtgatgctcaattatgcatgtttatgttttttttcatgtacaaacttagcccttgaatcggttttttaagtataaaaaaataaccaagagaccgtgtgatacaacctttagttccttgatcataatatagttaagagccattatgtataaagggtcgtgatcctttttaaagagatcgtaatattttgtactttttccagttaacttgctaagggcatgtataacctaaaaactctagatcggatttctaagtagaagagataattaagaaaatgtacgatacaacctagtgtctctacatcattaatgcagttaagacacaatatttatagaaatttgtgaagagatcagtaccccgtctctttatttttttcactaacgctctagagacttattaattaaaggggttacgttgtacgtgccctaagggcatatacaacttagagtcacttgttcggtttttcaagtaaaagaaactatatatgatacaattcggtgtctttaaactcagggggtgtttggtttctagggactaatgtttagtcccttcattttattcctttttagtgtataaattgctaaatatagaaactaaaataaagttttagtttctatatttggtaattttggaactaaaatggaataaaatctagtgactaaacattagtccctagaaaccaaacaccctttcaatcacattataaatgcagttaaaaaaaacaatatatagagagtacatgcccattatgggttgttttggcaacgacattaaggccccgtttcaatctcatgggataaagtttagcttcctgctaaactttagctatatgaattgaagtgctaaagtttagcttcaattaccaccattagctctcctgtttagattacaaatcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 47 - DNA, 2147 bp, Zea mays derived;
cgtctgtgtttgtaatcttcgctgctctattcaaaggaagggtggccggacccatccatagggctggtttgactcaattcacttagttttgtctccgctgaaattttgagtcgagtttgttcttgtgttcttcctttctctctctttatgaatttgtgaagaaccatcgagttcttgagttggtgattcatttggagattgttaggtgctttgatacactctttggatcactacatacatcccttggtgcatttcttagtcgtgatccaagttgatctcagtttgagtttgtttaagaaaaccctaacaaaacctcaattctgaccgtattttcatatctgcgattgattcacaaatttgattgagttcaacatttgtggagaccttggaaatacatttttcaaggtgtatgtaaaattttagctcaatcacggtcggttttgtttagtttcgcattcactgaattttgagctgctgaaatcagcacaagatagcgacacagttttgggccgattcggacttttctgtgcctgaagtgctatcctttcattttactgatctcgtgtgagtcttagaaacattttaaaaatcataagatcactggtttgctgatgtgcttttggtttgaacgtttttttatctcaattgaaatgaagtgctcaatttcagctttaagcatcaaaaatttaattgactcctattcacctttctgatcggctcaacgatcctttaatgacttatgagtactttctctgtttaaaattataaaatattttattttttaaaagtttaaatatctcaaatttatccaaaattataatgttctaatctgaagttgattttgggatggccgagtccaaatcattaaatgctagtttgggacagagaacatgtagctagagagaagtgattgaaaggtttgctatacctattttagaatatatgttttgaataggaaattttgtgaactttaatatagaggcttaaaagaaatacttaactcgtgactgcaatatgagataggatgtggaatatctagagatatattcatactgatagcgaacaggtgtggcaagggttttgtgatttggtgatgcatcgtaactgatgatttgtatagttcctttagtcatttgactaaattttagtgactaaaattatgtttggttttattgattaaatctgactaaggaacattaagtactatacataaagaccgtcttacccctatttaatagggcatagggaagaagggagggcatatactgtcacttttaccccttgctgatgaaaggactaaattttagttggagtgatttagactctgtttgggagagcttcattttaagaattacaacttcgattttctagcttcaccatgaaacgccttcaacagattggtaaggcagagttcaagagtgtttggcttgcacatagactacaacatctgtaatataattaatttgtgcgaatttcctgaattacccttgatgattagtgggtgaagaaagagacatgaatcggtaggtcatgtaaccaatggtatgctggataatttttgtataagtttatgaggatgtatgaaaataatgtttttgaagcatcatgtgaggagcttcgaaaatttcatgaaactggcctctagtttcaatttttttaattagagtttgtggagctagacctatttggaaacatcaaagctgaaatagacctgaaattaaaaaggtctcccaaacatgacattagttattatatttggttctttagtgactaaaagtgactttagcaccctaaaccaaacaggcctgaatcgtactccctctttcattttcccaacacctaaacaacgtaaagtttgattttaaataaataagaaatactgttatttatgatatatttaaaatattgtaagattaataatataatatttttatataagatataaatagtgctgttttttgtctagaaaaactagatgtgattttttttgacgtagagtactacaaaatcaggggcaattaaggacgttataacagccaagccgaactcttttgtgagctcaaaggccaagacccaacaaccaaacatcacctgcacaccacttgtcttgacacaccacacacaagaattgtatcaccgctgccagc

SEQ ID NO: 48 - DNA, 1000 bp, Zea mays derived;
ctctagcgagagctagacagtccaatatgccagttacatacttacattgcacacgtacatcaaacgaataaatgtcaagctattctaaattttaatactactgcaatggtgatgctcaattatgcatgtttatgttttttttcatgtacaaacttagcccttgaatcggttttttaagtataaaaaaataaccaagagaccgtgtgatacaacctttagttccttgatcataatatagttaagagccattatgtataaagggtcgtgatcctttttaaagagatcgtaatattttgtactttttccagttaacttgctaagggcatgtataacctaaaaactctagatcggatttctaagtagaagagataattaagaaaatgtacgatacaacctagtgtctctacatcattaatgcagttaagacacaatatttatagaaatttgtgaagagatcagtaccccgtctctttatttttttcactaacgctctagagacttattaattaaaggggttacgttgtacgtgccctaagggcatatacaacttagagtcacttgttcggtttttcaagtaaaagaaactatatatgatacaattcggtgtctttaaactcagggggtgtttggtttctagggactaatgtttagtcccttcattttattcctttttagtgtataaattgctaaatatagaaactaaaataaagttttagtttctatatttggtaattttggaactaaaatggaataaaatctagtgactaaacattagtccctagaaaccaaacaccctttcaatcacattataaatgcagttaaaaaaaacaatatatagagagtacatgcccattatgggttgttttggcaacgacattaaggccccgtttcaatctcatgggataaagtttagcttcctgctaaactttagctatatgaattgaagtgctaaagtttagcttcaattaccaccattagctctcctgtttagattacaaat

SEQ ID NO: 49 - DNA, 21421 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 50 - DNA, 5738 bp, Zea mays derived;
ctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaacttt

SEQ ID NO: 51 - DNA, 1152 bp, Zea mays derived;; identical to SEQ ID NO: 24

SEQ ID NO: 52 - DNA, 17546 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagttaactagtgtacatgcatcctagtctccatcgacaggcacgtaaccaaatatttatttccacgtgagattgagcaaggttacttatgttacacatgtcagtttgcgtttgtcgctgagagtggtaataatttctttttttattattttatgtcgttgaaaaaagtcatttattgtctctcacaaggtttaaaaaattgatgaaaccactcactttttaggaaaaccagaggtttcgagagcagtccggactccggcgaaacattttaagtgaaactagaggttttaagctagcccaaaatgcttgtgaaaaaataaacaagaggttttgagctagcccaaaattaataatattcaaactgaaatctattcgttcatttgacaaatttggtcggatttcactggttgtcaaacggttacaatataacatagtgagatgaatataaaaacaaaatcttatgatgtcaaactatataaatttctaaaaaccgatggtaaaaaaagatacaaaaatatttgacataacgtaactagattgacgagaataatttaacacggaggtagtatgcgcgtactaggtgttgtacactcgtttcatgtctataattactacgcgacatgctccctgggattcccgttccccggatcgatcgatcgatcaaccggattgggggttcgactgtcgctgctctagatagatcgatcgccgatcggctgctttaattttttattttgaagaaagagatggatcgatcgatcgaccaccactgttgcggcatgcatatatatactataccttcaaagtctcaccggtcagtccgtgtcacgtacgtcgatcgatcgacgaatctcgcatgcatgtgttcgttgccaggtatagcaaatgcgaggtttcgatttccagccccctctcccctccttctcgtttcatttcctttgttcgcaggtttgggttcctaacctaaacgatacgcatgaaaaacggagcggtttcttagcagataattaattaagtatttatttatttattttaaaaaaatagatcaatatagttttttaaagtaactttcgtatataaacttttttaaaaaaataaactgtttaatattttgaaaaacgtacgcatgaaaaataagagtaggtagttgggagggggggggggattgcagtgcatgcatgcgcttgtggctgtctagctaggtaggagtagctcgcgagcgcacagtgccatgcacatgcacacatccagatcaacagtaatggcgcctcatcgatccatccatccatccacatcgccggggagacgacgacgtacgacgagggccgcgcgcccggcgtggccttggcccagcgtctacgcgacacgtacacgcatgcacacgtacgtacatgcatagcttttttgctggctagccacagcgaatcaaccaacctaaagctatagtcacagcggcagagagctcgtcgatcgtacgttcgcgcgcatgctacatgcatgcatgcacatcgatgcagatgctatctccccagctacgtaggtgggctggctagctagcccctcggcccgtgtcgcctagggacagacgataccgacgacttttaataaaacttatagcaaaattatttatctatatattataatattatgatctaaatataattgctactatgatatcgatagatacgttataacaccaacgaatcgattttctgatacactgaggacgcgcgcccgccatacatcgtcgccgtcgccttttcgacgacatggacatggacatgtacacacacggtttaacctcgtgagctttactgcgacgagtgtagtgttgatgtggatgtaactgtaacagccgtgttcccgacagggcccaaccccacgccgcgcgcgcgccataatatcatcggtcgcgagctgagctctccctctcctcgcgcactagcttgctgtctctccctatagcttcttgttgttgttgttgttgttctctctcgcttcgacctcgtggatcctaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctagcgctcttgtgtgctttttcttgtccctagcttaattagctcttgtccgttaatttgcttgaatccctttcccgttatttcttgtgctttctttccttaatttaatttcctctctttgtgccatctggtcgatcttgtcatctgtgtggttcatgggacttgtgatttgagtgattgcagtgttcagttcaggggggaacattcgtgcatgcattgttaggtacactgatgacagatcagaaggtattttttttttacatgtggagctgcatgcctgtttgtagtacttgtcatctgtaaatgttctgtcctagaattgccttttcagttgcggttaattatccagctgctttgtgttgttgcattctactacctccgtcctataaaaattaaatttttacctttgaacctttgtcccataaaagttatatttctactaatgtgggacatattaaactgattacatttcattgtaatcttctttccttccatcccatctctaacccattgtttcaacattccttttaatcaagtttatatatggcatgtatgcatgtactgtgttcattaaataggattattgtagtcattttttttatcctgctaatatgtccttaattccttagaaattcagtttttatggggcggaggtagtattaagttaggatttttttttgttttgtaagaactactagtagggatgataatcagacacaatgggcacggattatatatagtagtagtagtagtagtatcaccttaatctccttagtttctgcagtatacaacactcacatctcagtctttttaatagttcttggccatttgaaacatgaggtttcctagtagcatatatgtacatatgtactgtgccatgagaggattcaagcttaaactgacagctacgattcgatatgatgtgtttcagagacatatctagaataggacgcaccaggtgattgcatgatgtgcacttattagagcaacaaagatctggttcggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 53 - DNA, 2000 bp, Oryza sativa derived;
agtgtacatgcatcctagtctccatcgacaggcacgtaaccaaatatttatttccacgtgagattgagcaaggttacttatgttacacatgtcagtttgcgtttgtcgctgagagtggtaataatttctttttttattattttatgtcgttgaaaaaagtcatttattgtctctcacaaggtttaaaaaattgatgaaaccactcactttttaggaaaaccagaggtttcgagagcagtccggactccggcgaaacattttaagtgaaactagaggttttaagctagcccaaaatgcttgtgaaaaaataaacaagaggttttgagctagcccaaaattaataatattcaaactgaaatctattcgttcatttgacaaatttggtcggatttcactggttgtcaaacggttacaatataacatagtgagatgaatataaaaacaaaatcttatgatgtcaaactatataaatttctaaaaaccgatggtaaaaaaagatacaaaaatatttgacataacgtaactagattgacgagaataatttaacacggaggtagtatgcgcgtactaggtgttgtacactcgtttcatgtctataattactacgcgacatgctccctgggattcccgttccccggatcgatcgatcgatcaaccggattgggggttcgactgtcgctgctctagatagatcgatcgccgatcggctgctttaattttttattttgaagaaagagatggatcgatcgatcgaccaccactgttgcggcatgcatatatatactataccttcaaagtctcaccggtcagtccgtgtcacgtacgtcgatcgatcgacgaatctcgcatgcatgtgttcgttgccaggtatagcaaatgcgaggtttcgatttccagccccctctcccctccttctcgtttcatttcctttgttcgcaggtttgggttcctaacctaaacgatacgcatgaaaaacggagcggtttcttagcagataattaattaagtatttatttatttattttaaaaaaatagatcaatatagttttttaaagtaactttcgtatataaacttttttaaaaaaataaactgtttaatattttgaaaaacgtacgcatgaaaaataagagtaggtagttgggagggggggggggattgcagtgcatgcatgcgcttgtggctgtctagctaggtaggagtagctcgcgagcgcacagtgccatgcacatgcacacatccagatcaacagtaatggcgcctcatcgatccatccatccatccacatcgccggggagacgacgacgtacgacgagggccgcgcgcccggcgtggccttggcccagcgtctacgcgacacgtacacgcatgcacacgtacgtacatgcatagcttttttgctggctagccacagcgaatcaaccaacctaaagctatagtcacagcggcagagagctcgtcgatcgtacgttcgcgcgcatgctacatgcatgcatgcacatcgatgcagatgctatctccccagctacgtaggtgggctggctagctagcccctcggcccgtgtcgcctagggacagacgataccgacgacttttaataaaacttatagcaaaattatttatctatatattataatattatgatctaaatataattgctactatgatatcgatagatacgttataacaccaacgaatcgattttctgatacactgaggacgcgcgcccgccatacatcgtcgccgtcgccttttcgacgacatggacatggacatgtacacacacggtttaacctcgtgagctttactgcgacgagtgtagtgttgatgtggatgtaactgtaacagccgtgttcccgacagggcccaaccccacgccgcgcgcgcgccataatatcatcggtcgcgagctgagctctccctctcctcgcgcactagcttgctgtctctccctatagcttcttgttgttgttgttgttgttctctctcgcttcgacctcgt

SEQ ID NO: 54 - DNA, 1000 bp, Oryza sativa derived;
agcgctcttgtgtgctttttcttgtccctagcttaattagctcttgtccgttaatttgcttgaatccctttcccgttatttcttgtgctttctttccttaatttaatttcctctctttgtgccatctggtcgatcttgtcatctgtgtggttcatgggacttgtgatttgagtgattgcagtgttcagttcaggggggaacattcgtgcatgcattgttaggtacactgatgacagatcagaaggtattttttttttacatgtggagctgcatgcctgtttgtagtacttgtcatctgtaaatgttctgtcctagaattgccttttcagttgcggttaattatccagctgctttgtgttgttgcattctactacctccgtcctataaaaattaaatttttacctttgaacctttgtcccataaaagttatatttctactaatgtgggacatattaaactgattacatttcattgtaatcttctttccttccatcccatctctaacccattgtttcaacattccttttaatcaagtttatatatggcatgtatgcatgtactgtgttcattaaataggattattgtagtcattttttttatcctgctaatatgtccttaattccttagaaattcagtttttatggggcggaggtagtattaagttaggatttttttttgttttgtaagaactactagtagggatgataatcagacacaatgggcacggattatatatagtagtagtagtagtagtatcaccttaatctccttagtttctgcagtatacaacactcacatctcagtctttttaatagttcttggccatttgaaacatgaggtttcctagtagcatatatgtacatatgtactgtgccatgagaggattcaagcttaaactgacagctacgattcgatatgatgtgtttcagagacatatctagaataggacgcaccaggtgattgcatgatgtgcacttattagagcaacaaagatctggtt

SEQ ID NO: 55 - DNA, 16582 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaggaaaagcaaattgagaagaagagagagagagagagagatagagagaaaacacggtcacgcctttcttgcgagtgacctactcacaaccaccttgagacaacggtacgagtgtgtgttattcagtaaatcatgctttgctttcagttaaaccccgaggttccactacctgtttttacggatggagagctagagaagagcctgccgaggggtaattcagacaagaaacgtacgccgcctgtatatatatatgcagcactagctagccctgccacacatgcatgaggcaacgcaacggtcccggactggtcctgcaatacaaaaggattcttcagttagcagtagctttcagctgatcgattcacttctcctccccgtctgttgagtcattacccgcaggcgtttcgtcaccgctttcagaattcagacagaggtcggtcgccaggaacccataaaaaaaggtagctttatgtttccctcttgctccgtcgtcgtcgtcgtcgtcgtcgtcgtcgccgccgccgttgctcgataggatgtttagaaattaactgcttgtgcacacagaggttacagttccttgtagactccttcagttcagaaatgaccatgcaatgcatgctagtttctgtttacagtttccaagcatgcatggttttgttgcctgtgagtagatgatgttggagtacgtaacgtagtaacattgagcagtgatgtgaattgcgatgatatacgtgacgccgagagagcacatgaacaggtcagactgtacccttgcgtgcctagctagctcaagttcttttcttgcagccttttcttcaaatcccacacacccttgacatcggccggcgatccgatctctatcctgattcctgacacacaagcacggccacggaaccctcgcgcatgcatgctgcctgctgacgcttaccttcgtttcgttttcatggctgctgctgcttattgctgcgagtgcgatgtgcaggcggcagcgggcacagtcctccagtcctcgggtgaggcgatcgtcgccggcgcctaggatcctataaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaattaatcattatttaattgcgttcgttcatgttgaaagttcgatcaaactatcaaaggatggatcaactaataaaaacgggatccatatataagtaactgtgaattgcgatcattaattgtatgcatacaagcatatggtcgtggattaaagtttgttaattgggttttctcactgcttttctggatctttcttgtgttggttcaaacgagggcggaataataaagctatttcctctatgtttttatacaaggtaaattaaatttcgggtctttgcatgagctgtgcgctaaaagcgcttattacaagtttcggcctccatgtataaaggctagtttggtaacactattttccgaaatgattcctatttttttaagggaaaatgaactaatttcctttagaaaatgagatttccaaactagccctaaaagaaaattctaggctaaaaaagacaacatgttgcactctatttctattgattttaactaaaattaattaagggatcaaacaaattctgaagagctataagtatgaatctatgacttagaccaattggacatactctaaataagtttggctaagtcataggaaagctatcaagaacacccaaactgaattagagaagaagatcaaaaaagagtcaagtttgtgttgggctgaggcacaccgggccggtccggtggtgcaccagatcaaagttctagagagcttccataactagagtttctagcctagcgcattgtacctcttttctagagaggtctagaactacaatgctcgaggagatggcacaccagccaagttcgattgagagaatctggctgtggggagaatctgagtatcattacgattacgtgtggagtaagataaagttgttcatagggctcaggatttataaagtgacggattcctactattacaacgactcaaccgattatgtgtttatgttgattttggatggtttttgcccaaacgaattttatagaagcttgctgaaaagctgagttagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 56 - DNA, 1038 bp, Zea mays derived;
aggaaaagcaaattgagaagaagagagagagagagagagatagagagaaaacacggtcacgcctttcttgcgagtgacctactcacaaccaccttgagacaacggtacgagtgtgtgttattcagtaaatcatgctttgctttcagttaaaccccgaggttccactacctgtttttacggatggagagctagagaagagcctgccgaggggtaattcagacaagaaacgtacgccgcctgtatatatatatgcagcactagctagccctgccacacatgcatgaggcaacgcaacggtcccggactggtcctgcaatacaaaaggattcttcagttagcagtagctttcagctgatcgattcacttctcctccccgtctgttgagtcattacccgcaggcgtttcgtcaccgctttcagaattcagacagaggtcggtcgccaggaacccataaaaaaaggtagctttatgtttccctcttgctccgtcgtcgtcgtcgtcgtcgtcgtcgtcgccgccgccgttgctcgataggatgtttagaaattaactgcttgtgcacacagaggttacagttccttgtagactccttcagttcagaaatgaccatgcaatgcatgctagtttctgtttacagtttccaagcatgcatggttttgttgcctgtgagtagatgatgttggagtacgtaacgtagtaacattgagcagtgatgtgaattgcgatgatatacgtgacgccgagagagcacatgaacaggtcagactgtacccttgcgtgcctagctagctcaagttcttttcttgcagccttttcttcaaatcccacacacccttgacatcggccggcgatccgatctctatcctgattcctgacacacaagcacggccacggaaccctcgcgcatgcatgctgcctgctgacgcttaccttcgtttcgttttcatggctgctgctgcttattgctgcgagtgcgatgtgcaggcggcagcgggcacagtcctccagtcctcgggtgaggcgatcgtcgccggcgcc

SEQ ID NO: 57 - DNA, 1000 bp, Zea mays derived;
tcattatttaattgcgttcgttcatgttgaaagttcgatcaaactatcaaaggatggatcaactaataaaaacgggatccatatataagtaactgtgaattgcgatcattaattgtatgcatacaagcatatggtcgtggattaaagtttgttaattgggttttctcactgcttttctggatctttcttgtgttggttcaaacgagggcggaataataaagctatttcctctatgtttttatacaaggtaaattaaatttcgggtctttgcatgagctgtgcgctaaaagcgcttattacaagtttcggcctccatgtataaaggctagtttggtaacactattttccgaaatgattcctatttttttaagggaaaatgaactaatttcctttagaaaatgagatttccaaactagccctaaaagaaaattctaggctaaaaaagacaacatgttgcactctatttctattgattttaactaaaattaattaagggatcaaacaaattctgaagagctataagtatgaatctatgacttagaccaattggacatactctaaataagtttggctaagtcataggaaagctatcaagaacacccaaactgaattagagaagaagatcaaaaaagagtcaagtttgtgttgggctgaggcacaccgggccggtccggtggtgcaccagatcaaagttctagagagcttccataactagagtttctagcctagcgcattgtacctcttttctagagaggtctagaactacaatgctcgaggagatggcacaccagccaagttcgattgagagaatctggctgtggggagaatctgagtatcattacgattacgtgtggagtaagataaagttgttcatagggctcaggatttataaagtgacggattcctactattacaacgactcaaccgattatgtgtttatgttgattttggatggtttttgcccaaacgaattttatagaagcttgctgaaaagctgagt

SEQ ID NO: 58 - DNA, 15838 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaggaaaagcaaattgagaagaagagagagagagagagagatagagagaaaacacggtcacgcctttcttgcgagtgacctactcacaaccaccttgagacaacggtacgagtgtgtgttattcagtaaatcatgctttgctttcagttaaaccccgaggttccactacctgtttttacggatggagagctagagaagagcctgccgaggggtaattcagacaagaaacgtacgccgcctgtatatatatatgcagcactagctagccctgccacacatgcatgaggcaacgcaacggtcccggactggtcctgcaatacaaaaggattcttcagttagcagtagctttcagctgatcgattcacttctcctccccgtctgttgagtcattacccgcaggcgtttcgtcaccgctttcagaattcagacagaggtcggtcgccaggaacccataaaaaaaggtagctttatgtttccctcttgctccgtcgtcgtcgtcgtcgtcgtcgtcgtcgccgccgccgttgctcgataggatgtttagaaattaactgcttgtgcacacagaggttacagttccttgtagactccttcagttcagaaatgaccatgcaatgcatgctagtttctgtttacagtttccaagcatgcatggttttgttgcctgtgagtagatgatgttggagtacgtaacgtagtaacattgagcagtgatgtgaattgcgatgatatacgtgacgccgagagagcacatgaacaggtcagactgtacccttgcgtgcctagctagctcaagttcttttcttgcagccttttcttcaaatcccacacacccttgacatcggccggcgatccgatctctatcctgattcctgacacacaagcacggccacggaaccctcgcgcatgcatgctgcctgctgacgcttaccttcgtttcgttttcatggctgctgctgcttattgctgcgagtgcgatgtgcaggcggcagcgggcacagtcctccagtcctcgggtgaggcgatcgtcgccggcgcctaggatcctataaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttaaggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 59 - DNA, 1038 bp, Zea mays derived;; identical to SEQ ID NO: 56

SEQ ID NO: 60 - DNA, 253 bp, Artificial, vector component;; identical to SEQ ID NO: 12

SEQ ID NO: 61 - DNA, 15412 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctacgaacatgccctaaataaattagaaacactacatacatatacatctccatgtattaaaggcatgcgcttgctactgctacctgcgaaatattatcaagaatggcaagtaaactcccctgcttggtgctcacagcaaattcgtctcacgcatattcgtcatccagctccgtttaaaatgcgtgctcattatccctcaagcatgcatatactatatatgatgcagatcatatatgacctttatacaattatcaccacctcgattcctcgcggcacatctttgcaccgcagaacgaccgtgcagtattttatacaaacatctactctcgatctacccatgagctaactcccaatatataagcgagccgaacttttctcctatctgagcactgctgctgctgaaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaccctatcgagatttcaagtttcagcatggtctagggactaggcctctagctgtgataatgaatatcaatcaacacatctgtaactgggtaactgctctagcctctagagtaggttttatttttctctagatatttttttaatctcctctagacatactcctagcttccgcatgttgttggttccatttcaccacacccctagatgcattgttcagcatttcgcgggaataatgagaattatgctgaaaaggcatgatcgctcctcctgcctattctacagaaaattaaataaagaaccgccatttcatcaaataaaccaaaggccgtgttctgtggattggaagggatcgaggaagattaaatcgtttctatttaattttcccttaattttaactagttaatctcatggagttccttctaatctacttctaactgaacaagaccaagcccaaaagggaaaaacacttgattacctacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 62 - DNA, 401 bp, Zea mays derived;
cgaacatgccctaaataaattagaaacactacatacatatacatctccatgtattaaaggcatgcgcttgctactgctacctgcgaaatattatcaagaatggcaagtaaactcccctgcttggtgctcacagcaaattcgtctcacgcatattcgtcatccagctccgtttaaaatgcgtgctcattatccctcaagcatgcatatactatatatgatgcagatcatatatgacctttatacaattatcaccacctcgattcctcgcggcacatctttgcaccgcagaacgaccgtgcagtattttatacaaacatctactctcgatctacccatgagctaactcccaatatataagcgagccgaacttttctcctatctgagcactgctgctgctgaaa

SEQ ID NO: 63 - DNA, 464 bp, Zea mays derived;
tcgagatttcaagtttcagcatggtctagggactaggcctctagctgtgataatgaatatcaatcaacacatctgtaactgggtaactgctctagcctctagagtaggttttatttttctctagatatttttttaatctcctctagacatactcctagcttccgcatgttgttggttccatttcaccacacccctagatgcattgttcagcatttcgcgggaataatgagaattatgctgaaaaggcatgatcgctcctcctgcctattctacagaaaattaaataaagaaccgccatttcatcaaataaaccaaaggccgtgttctgtggattggaagggatcgaggaagattaaatcgtttctatttaattttcccttaattttaactagttaatctcatggagttccttctaatctacttctaactgaacaagaccaagcccaaaagggaaaaacacttga

SEQ ID NO: 64 - DNA, 17667 bp, Artificial, vector;
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctgtcactctaccaaaatactagtgctcaaatgccactctcccaaatattcattcctaaatgtcacccggacctcaccacttatgtttgaatgaaaagtgaggctgacatgtgcgttcggatggcatttgggaatgaaaatttaggagagtggtatttgagtgctatcattttggtagttgcaaatagtaaattctccccctattttctatgacactaaactcagcccaatactataaattggactaaaatatattttgaaacggaggtagtagtataacatatactatgtcctaaggctaaaaaggtgtgggggcgaagcaaacatttacctagaaaactacgccataatcaaaatgtggcattacaaagtgaagcaactaaccaaataaccccaagtaatattagtaagaaaatcccccaccagatttttcaaattctcaatcgcaagatctgtcatctaaaatctacattttatctccaccctccaatacaaacaaatagtcaagccctagccaccacttccacatcgctcctcctaacctcaccctgtgctacgctgaaccaatcatgccctctgcaccaccaccatttagcctcaatggcatctccctcaacgctggtgatgctcgccgacaagcacctccatcgccatccctattgccatcatcctccttgagatggcttctcatgtgccatcaccatttcttatgtccttacgctgttgtcttcctcgtctctaatggtcttgtcgctgaattcatgaccaccaccacctaaccaatctagcgaggtgcctgaccctattctcatcttccgtctcgagcaactcaccatcacctaattacatgatcgggattctctcgccataaccactatccattgtcctcgtagctacgacggcgtcactgtcatctcgttgccttcccaatgccaccgtccaccatcaggccgctatctccttagcctcactctaagcggaggaacctatgctctctctaactggtcagaccactgtcaatgtctctggacataatcaacattgttggagaggcagagagcagaaattgtgaggtagatataaaggttagatatttgtaagattttcctcttaattttcaatcgaatgtggtttagggaaatggatattttttttactagactggcgtatagcaatccgaagacgaagaaagaaggaggaggagtaaaacacaaaaaaagaaaccaaccgtcttaaaacttacaactttaccattgggcaatacaactgcaatgggccaagaagttaatttaaagttaagagcaaattcatttggaccaccttttgttacagatgcttcactttggaccacataccacccatctctcttctcgagcatgaacaatctcgattacattggctcctactcatcaataaactctcacatatatatgtaaaaccattcatcggtatatgacaagttatatatggataaaagagttgaggatgggtaagaataataaccggtataaagtgagaacattgataaacatcgctaataaaagttcgtctatagtaaaatttactctaaaattaaatcacctaatattttaatatttttttgtacaaatggaccgtttcaatggggctttatcagatttagttgagatgcatacatggtaagcaccgtcataatcttgcccaagagctgacccaactcattaaaattacgcttcttttacgacttaataaatcaagaagaaaccattgaaatccagcctgccccgactgtctcgtaacagaaaaataactcagcaacgactaaattatgattttaaaatggcaaaaatatcaaagcacgttcgaaacaatcgcaagattggcaagtaaactctcctgcttgcttgctcacaaccacatcagatcattgatcaatgtttcatcagctcatcacttctgcatgcatgttatattcttctcagggctccacaatttacaaagctgctcgaagatcttctttgcagtgcaaagcaatctgcaagattattcaagacatctactcttgatctaccattgagctaactccggatatataaacagaccgaacgtttcgtcccaggggaatgtgaaagttagcgaatttgcccggcgaaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaatgaacaaaagataatttcgtttcaggagcaaaaaaatgcatgtaattcaaggaaaagaaaatgttcaactgtctttagagtttagagtagattttatttgcacccacttaatttttactcttctctagacataggttcagtatctgcttgttgattatgtaaccttgaagaagcattgcaaaaacaaagcggaaacttatgttaccaagggcatgacgaagaaataaatggattagatttcattgacacttagaaaatggaaccagcaaatcaaggctgaaaataattacactagaaacttattttaatggctttacatgtcgctacatacttaaatcaatcaaagttgctaccaaagccatgttccctaaacagagggttccgggctttcaaacattcttaatcttctatacattgataaaaagtatacataaaaagaaaacctattaagatggaaatgttgaattctcttaagaaaggcataaaaaatgcagggtaataaccttttcttgtcatgtcctacttggtttcaacctatattgctagcaaaattttcacgctatctataacctcaggaagcagaatagctcagaatcactagcaattgtatacttacagataatcgaaattcatattgtgaggttttcttggatggctcggaatgatccacagatgttaccacccatgtctgggaatgacgtacatcctggcaagggtttcaccttgcccttacggtcaacacttacagggtacttcattaggtggcctctcatctcagtcacctcattatcaacaaatcgttcccagttctgttcaccgatttggcgaactcgtctcatgcattccatggtctctggatagttgaagccttcctcaaccactccaatatgctccgcccaaagagacattctgtacccataaatctacacatgaaatcagcagatttgaattagagtgtggttctagaaatatcagtcatcctaaaataggtatatccctaacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 65 - DNA, 2132 bp, Oryza sativa derived;
tgtcactctaccaaaatactagtgctcaaatgccactctcccaaatattcattcctaaatgtcacccggacctcaccacttatgtttgaatgaaaagtgaggctgacatgtgcgttcggatggcatttgggaatgaaaatttaggagagtggtatttgagtgctatcattttggtagttgcaaatagtaaattctccccctattttctatgacactaaactcagcccaatactataaattggactaaaatatattttgaaacggaggtagtagtataacatatactatgtcctaaggctaaaaaggtgtgggggcgaagcaaacatttacctagaaaactacgccataatcaaaatgtggcattacaaagtgaagcaactaaccaaataaccccaagtaatattagtaagaaaatcccccaccagatttttcaaattctcaatcgcaagatctgtcatctaaaatctacattttatctccaccctccaatacaaacaaatagtcaagccctagccaccacttccacatcgctcctcctaacctcaccctgtgctacgctgaaccaatcatgccctctgcaccaccaccatttagcctcaatggcatctccctcaacgctggtgatgctcgccgacaagcacctccatcgccatccctattgccatcatcctccttgagatggcttctcatgtgccatcaccatttcttatgtccttacgctgttgtcttcctcgtctctaatggtcttgtcgctgaattcatgaccaccaccacctaaccaatctagcgaggtgcctgaccctattctcatcttccgtctcgagcaactcaccatcacctaattacatgatcgggattctctcgccataaccactatccattgtcctcgtagctacgacggcgtcactgtcatctcgttgccttcccaatgccaccgtccaccatcaggccgctatctccttagcctcactctaagcggaggaacctatgctctctctaactggtcagaccactgtcaatgtctctggacataatcaacattgttggagaggcagagagcagaaattgtgaggtagatataaaggttagatatttgtaagattttcctcttaattttcaatcgaatgtggtttagggaaatggatattttttttactagactggcgtatagcaatccgaagacgaagaaagaaggaggaggagtaaaacacaaaaaaagaaaccaaccgtcttaaaacttacaactttaccattgggcaatacaactgcaatgggccaagaagttaatttaaagttaagagcaaattcatttggaccaccttttgttacagatgcttcactttggaccacataccacccatctctcttctcgagcatgaacaatctcgattacattggctcctactcatcaataaactctcacatatatatgtaaaaccattcatcggtatatgacaagttatatatggataaaagagttgaggatgggtaagaataataaccggtataaagtgagaacattgataaacatcgctaataaaagttcgtctatagtaaaatttactctaaaattaaatcacctaatattttaatatttttttgtacaaatggaccgtttcaatggggctttatcagatttagttgagatgcatacatggtaagcaccgtcataatcttgcccaagagctgacccaactcattaaaattacgcttcttttacgacttaataaatcaagaagaaaccattgaaatccagcctgccccgactgtctcgtaacagaaaaataactcagcaacgactaaattatgattttaaaatggcaaaaatatcaaagcacgttcgaaacaatcgcaagattggcaagtaaactctcctgcttgcttgctcacaaccacatcagatcattgatcaatgtttcatcagctcatcacttctgcatgcatgttatattcttctcagggctccacaatttacaaagctgctcgaagatcttctttgcagtgcaaagcaatctgcaagattattcaagacatctactcttgatctaccattgagctaactccggatatataaacagaccgaacgtttcgtcccaggggaatgtgaaagttagcgaatttgcccggcgaaa

SEQ ID NO: 66 - DNA, 999 bp, Oryza sativa derived;
tgaacaaaagataatttcgtttcaggagcaaaaaaatgcatgtaattcaaggaaaagaaaatgttcaactgtctttagagtttagagtagattttatttgcacccacttaatttttactcttctctagacataggttcagtatctgcttgttgattatgtaaccttgaagaagcattgcaaaaacaaagcggaaacttatgttaccaagggcatgacgaagaaataaatggattagatttcattgacacttagaaaatggaaccagcaaatcaaggctgaaaataattacactagaaacttattttaatggctttacatgtcgctacatacttaaatcaatcaaagttgctaccaaagccatgttccctaaacagagggttccgggctttcaaacattcttaatcttctatacattgataaaaagtatacataaaaagaaaacctattaagatggaaatgttgaattctcttaagaaaggcataaaaaatgcagggtaataaccttttcttgtcatgtcctacttggtttcaacctatattgctagcaaaattttcacgctatctataacctcaggaagcagaatagctcagaatcactagcaattgtatacttacagataatcgaaattcatattgtgaggttttcttggatggctcggaatgatccacagatgttaccacccatgtctgggaatgacgtacatcctggcaagggtttcaccttgcccttacggtcaacacttacagggtacttcattaggtggcctctcatctcagtcacctcattatcaacaaatcgttcccagttctgttcaccgatttggcgaactcgtctcatgcattccatggtctctggatagttgaagccttcctcaaccactccaatatgctccgcccaaagagacattctgtacccataaatctacacatgaaatcagcagatttgaattagagtgtggttctagaaatatcagtcatcctaaaataggtatatccct

SEQ ID NO: 67 - DNA, 15838 bp, Artificial sequence; identical to SEQ ID NO: 58
  synthesized vector

SEQ ID NO: 68 - DNA, 1038 bp, Zea mays derived;; identical to SEQ ID NO: 56

SEQ ID NO: 69 - DNA, 253 bp, Artificial sequence; identical to SEQ ID NO: 12
  synthesized vector component

SEQ ID NO: 70 - DNA, 17543 bp, Artificial sequence
  synthesized vector component
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttagaaagtgcatagttaattcaaacaaatctttatttgcaaatatgcaaaaggatatattaaaaagaaatcaacatcatgatcagttggaagtcatcacaaagaagagatcagaagccgggatagcagcagactcttataaagaatttaaacaaggggttgtggctgggcggatgtatgatggtagatctgtactcgttggcttgtcaagctcgtaggctgccagcaggcttgtggcgggatcgggattaggtgcccctcccccctcccccatatcccgggatcgggattaggtgcccctcccccataccccgtggctccatcctcagcaccaggcaaatattctctctcttcgcaaacatattagaacaaatacaaaaatgattacaaacagtttaaaattttccgttttaaaagaccatatccaagccacaagggtgacctactgatcgattatcaacttgtcctactccgaatttttctatcagccccctcccagattttgtaggagcatatgcctctcaccacgtggacttacagtatcccgtaccctgcccccctgccctcacgtaatagggcctcagtgcctcaccatgatgccctttatcattcgctcaccactagagcacctacacctttccagtgggcccaccacgccctggacacttgttaacagtttatcaatgtaccatatccatttcatcaaatgccatatctgagagcgagagagagagcataaagctatgggtatggccaataataaagaggccaagcagcagctggtgaaagaagagacaaaatagagtacagtgatgtaaatgtacatgaacacagtggaacagcgacacacacacacacaccatgcactttgctcagcttgtttcagagcatctatcagctctgagtcgtcttgagtcttgactactactcgtactaccactagctctcttgagcttgagcaccagcccaggctctactgcagcagctgccatacatttctagtagctgattacatatcgtatacttaattagcactttgcacttgtgtactagtatgtgaatgtgaccatgaacaccccccccccctctctctctctcgcctgcatctcatctcttcttttactacctctgttttttaatatctaacgtcaacgacgttttggcaacgtttaaccattcatcttataaaacttttttgcaaatataaaaaagtttagagattttctccggtccagcaaaaagtacctcgaggtaccggtacattacggtactgaatcgtttccgatcgttggatctagctggacagtatggacattgttagatccaacaatcgaaaacgatttggtaccgtgaggtaccggtacctcgaggtactttttattggactatagcaaatctaaaaaaattaagtcatgtttagaaaacatttgacgataaatcaagtcacaataaataaatgataattacataaattttttgaataaaatgaatgatcaatcgtatctcaaaaagtcaatgatgtcatatattaaaaaacagatggattaaggtttagttttgccccttccattgatctggtcataccacaacacacaattgcacacatagaattaagaagaacaagaagacgtgtgtacaagtgtagtactccctccgtttcgtaatgtaagacttttgctcatattcatatatatgttaatgaatctagacacatacatatgtctagatttattaacttctatatctagattcattaacatctatatgaatgtgggtaatgctagaaagacttacattatgaaatggaggaagtagactagtagtgacggcaatggtagaattatcactatcagttattgcatccatattacatgtactatcactatgttgtgtacttgagctaggaagagcataattcagtttctgcctgatataaagacacacataatctcaagtggagttgttattggttggggttagtgctatcttcagcttcactacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctagccagtaaaggtgatttcttgtgttaaacaatcaaacaaaaataggtatgaaaactttgaaggctttgtatttatatggcttggttaatttggccttcctctgtcatgatattttgctacttaatttgctagttcacttctctatgaatcaattatcaataccggtttggcttgttatttgttgttttttttattttgagaaaagacttgttgatttgttgataacttgatatgctaatttcgagtatttgttacttccgatttttggatatgtgctatagtttttttctggctatattttctgatttttggtttgtttctatgtgctagtttttggctgacttaattttggtttgtccatgtgctaactttgagatttttgaagtttctctaattagttctccggtgatccgtggttggccatacgagtactcaattcttaggaacattttgtatcgaaaggtttgagctagaaatttcaggtgtaatccctgcaccctagaattctagctagatagaagaaatttaatactcgatcttgatgtttttataacagtaacagcatgatgacaaaccaatattttgtcctaaaaaatataccattgaacagtaattgatgttgtaaaatcatttcagtttctctgctaatgaaaattgagggttccttcctcgtcatttttctaaaataatggtaaaatttattgttttgcatgagaaggatgtttttaacttgctagcactagatctgcaatcacctgcatcaggatcataagaaccataagtgcctaagttgagaaactcaaaagcatgcataaatatatgatatatgatgatgtatgaaacattttatgaatttggtcatggtcagaaactaacatcaacaggtaaatgtatatcctttgtccaaattaagtttggggacagaggatgaacaagctagttacctatggttttgcaagtaatttctactatataaaagaacctagtggtggtgaatcttaattacctacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 71 - DNA, 2000 bp, Oryza sativa derived;
ttagaaagtgcatagttaattcaaacaaatctttatttgcaaatatgcaaaaggatatattaaaaagaaatcaacatcatgatcagttggaagtcatcacaaagaagagatcagaagccgggatagcagcagactcttataaagaatttaaacaaggggttgtggctgggcggatgtatgatggtagatctgtactcgttggcttgtcaagctcgtaggctgccagcaggcttgtggcgggatcgggattaggtgcccctcccccctcccccatatcccgggatcgggattaggtgcccctcccccataccccgtggctccatcctcagcaccaggcaaatattctctctcttcgcaaacatattagaacaaatacaaaaatgattacaaacagtttaaaattttccgttttaaaagaccatatccaagccacaagggtgacctactgatcgattatcaacttgtcctactccgaatttttctatcagccccctcccagattttgtaggagcatatgcctctcaccacgtggacttacagtatcccgtaccctgcccccctgccctcacgtaatagggcctcagtgcctcaccatgatgccctttatcattcgctcaccactagagcacctacacctttccagtgggcccaccacgccctggacacttgttaacagtttatcaatgtaccatatccatttcatcaaatgccatatctgagagcgagagagagagcataaagctatgggtatggccaataataaagaggccaagcagcagctggtgaaagaagagacaaaatagagtacagtgatgtaaatgtacatgaacacagtggaacagcgacacacacacacacaccatgcactttgctcagcttgtttcagagcatctatcagctctgagtcgtcttgagtcttgactactactcgtactaccactagctctcttgagcttgagcaccagcccaggctctactgcagcagctgccatacatttctagtagctgattacatatcgtatacttaattagcactttgcacttgtgtactagtatgtgaatgtgaccatgaacaccccccccccctctctctctctcgcctgcatctcatctcttcttttactacctctgttttttaatatctaacgtcaacgacgttttggcaacgtttaaccattcatcttataaaacttttttgcaaatataaaaaagtttagagattttctccggtccagcaaaaagtacctcgaggtaccggtacattacggtactgaatcgtttccgatcgttggatctagctggacagtatggacattgttagatccaacaatcgaaaacgatttggtaccgtgaggtaccggtacctcgaggtactttttattggactatagcaaatctaaaaaaattaagtcatgtttagaaaacatttgacgataaatcaagtcacaataaataaatgataattacataaattttttgaataaaatgaatgatcaatcgtatctcaaaaagtcaatgatgtcatatattaaaaaacagatggattaaggtttagttttgccccttccattgatctggtcataccacaacacacaattgcacacatagaattaagaagaacaagaagacgtgtgtacaagtgtagtactccctccgtttcgtaatgtaagacttttgctcatattcatatatatgttaatgaatctagacacatacatatgtctagatttattaacttctatatctagattcattaacatctatatgaatgtgggtaatgctagaaagacttacattatgaaatggaggaagtagactagtagtgacggcaatggtagaattatcactatcagttattgcatccatattacatgtactatcactatgttgtgtacttgagctaggaagagcataattcagtttctgcctgatataaagacacacataatctcaagtggagttgttattggttggggttagtgctatcttcagcttcacta

SEQ ID NO: 72 - DNA, 1000 bp, Oryza sativa derived;
agccagtaaaggtgatttcttgtgttaaacaatcaaacaaaaataggtatgaaaactttgaaggctttgtatttatatggcttggttaatttggccttcctctgtcatgatattttgctacttaatttgctagttcacttctctatgaatcaattatcaataccggtttggcttgttatttgttgttttttttattttgagaaaagacttgttgatttgttgataacttgatatgctaatttcgagtatttgttacttccgatttttggatatgtgctatagtttttttctggctatattttctgatttttggtttgtttctatgtgctagtttttggctgacttaattttggtttgtccatgtgctaactttgagatttttgaagtttctctaattagttctccggtgatccgtggttggccatacgagtactcaattcttaggaacattttgtatcgaaaggtttgagctagaaatttcaggtgtaatccctgcaccctagaattctagctagatagaagaaatttaatactcgatcttgatgtttttataacagtaacagcatgatgacaaaccaatattttgtcctaaaaaatataccattgaacagtaattgatgttgtaaaatcatttcagtttctctgctaatgaaaattgagggttccttcctcgtcatttttctaaaataatggtaaaatttattgttttgcatgagaaggatgtttttaacttgctagcactagatctgcaatcacctgcatcaggatcataagaaccataagtgcctaagttgagaaactcaaaagcatgcataaatatatgatatatgatgatgtatgaaacattttatgaatttggtcatggtcagaaactaacatcaacaggtaaatgtatatcctttgtccaaattaagtttggggacagaggatgaacaagctagttacctatggttttgcaagtaatttctactatataaaagaacctagtggtggtgaatct

SEQ ID NO: 73 - DNA, 20159 bp, Artificial sequence
  synthesized vector
gaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttagattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcctaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaaattagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttaacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccg

SEQ ID NO: 74 - DNA, 4616 bp, Oryza sativa derived;
tgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttagattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcct

SEQ ID NO: 75 - DNA, 1000 bp, Oryza sativa derived;
gatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgt

SEQ ID NO: 76 - DNA, 17622 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaataatcatacaggcagagaacatctgtagggctaaccctaattaagaatacaatctacttaatccccctcgtagctagggtatatatacaaataattaacgggtatggcagtgcatgcatgcatgccgatgacttgcactggtaccagttcgtcactaatgattgccaattatactgcggcccttttaattatgagatggaagcagcaggaggcaagctagttcaattgtccggtttgttaagccgcattgctcaagagcacccctgcctgcgccatcgatcgccacacggtgtgtgccagtctacatcgccggcctctttatcattgtgctagtagctgcttattaggcaaagctcaattacgcagctaagccagttgatatgcataaaagggaatgattactcttaaaccggacgcactggcgctttctgcttttttttaaaggaatgctatgaaaattggtacgtacgtagtactactactatgcatatcagtttttttcttcttcttttttttcttatacatatatcagtataccagtctgtatatatgtacacacacttcgttcttcagctacgacgtacaatactgctacaccccatgggctgcgggaactgttcgtgaaaagtgacgagatgaggcagcactgtggtagatattcttgcgagtagtggcaatgtcaccctcacacttttccttgtactgccattaatcccaatttgtccttatttatctgtttaccctctctttctctctcctcggccgggcccttttttttctttgcaacatacaccaccacaatattcttcaacactctcacctcctctcattcaatactgtctctcagcctttttttttcatagtgtgtgcggccgatctatgcacctcacctttcccttgctgcagttggaggaagtgtgctgcaggtggaagaagagaggggagaagctggttcccctctccatatctctcctccccagctccctccccctctcatagatcgatcacacagcctgcaggcacagacaagagttaggctgttctacctgatcatatgaccctccagcaattctctcatccacacacaaactgaagcaagaattattgcttatctatatcctgtctgtcctttcctctatttcccccctcccctttctatttccattgtgcagcttgttattagtagatagcagtggatcgatgtgtgatggaggaaacaagctagctagctagctaccagctgaagcagcagggagaagaaggatagagagagagagagagagagaaaacatcttcttcatccatagtctcggcctttcttcaccaggtcgtctgcagatctgtctcctgtgaccttccagaggtgaggatgagcaggtctctctagctcactgcgctacatgcccatgtatgagaagttctattttagaagacaaaaaggctttgatctgcagtcttcgttctcgtcttctgggttctggccttctcttgcttggcagtggcactattattatattatctatggttcttgagatttgagcaaataaagatcgcctttttttcctttaaaaaatctgtgcttcttgtgccgtatcatcatacatgcacacccacgcatttgtacagtggatcatgcatcctccatttgtgttcatgatcatgctgttgatttgcactgctccctttatcaataattttccgcagatgagaaatctacagtctcattattgtcccctctttctttgtcccaaggtaaaaagggaagaacagaacttccccatttttcccaaagattgcacatgcatagctggctggatcagagcacatcacactccgaaaccctaatcttctccctctcctcgtgcctttcccagaacaatatataatcctccgtccaagaaaaccctagccctaagattagtatcgaaagatcgcgatgcatattattcacagctcagccaccacaccaccatatgtagagatagatatacgtatatttctttgggaaaaaacggataataatccaactaattaatcaacgtttttctactgatttattcgcaggccaagctaggccaggaaggaaaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcactaagtgaaggggaagcgctgcgctgccgtgaatggtaaggcgctgtttctttctctctgagtaattaagtttaatcctgcacggcggccatgcccatgcatgatgtatagctactgtatgtgctagctagtttgtgtgttttaattatatacatatatagctgttcttatctgtgtgtgcgttgctttgcttattactatgcttgtgtagtgtgttgtgcagtgatgtattactctaatccttgttaagatgtggaggcgacgacatggatttgagccctttgaccttaatgagctgtgggatcggacggcggagtcggtgaaggaaggaaggaaggaagcttcaggggggggggggagacgatgtcatgggagcccaatcgatctcagcaggttgattaagagctaaggagcaatctatctatctatctatctacctacctttcgctatatatatctatatagccgacatgaattatatatatcgactgcatctatcccctttctgcatgttgtgcaaaccaatactttggagtactaaatgtaatcgagccgagatcttgatctctcttcttttcatgattaattcttcgttctcgcaggatccatccatccatcatcatcatcatcatcagtcattagcacactatgcatgcatgcatgctttggcctttgcgatcagaaaacaaaacagccacctttaggccttgataaataaaatacacaagagccaatcaaaggcagcaggttcctacatgcatgcatgagtagtagtgtagtactaagctgatctcttgggccaattaaagggctgcatgcatgatctgcatcttatatcatatgtcataggcaccagtggcctatgctcttgcatatatgctccagatatatgcatgatcgtcagatgggagatcgagctagctagctagggacgagaggggagagattaataacgacgagcacacagttattagttgtttaaactatattatatatacataaacggaccgctagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 77 - DNA, 2090 bp, Zea mays derived;
aataatcatacaggcagagaacatctgtagggctaaccctaattaagaatacaatctacttaatccccctcgtagctagggtatatatacaaataattaacgggtatggcagtgcatgcatgcatgccgatgacttgcactggtaccagttcgtcactaatgattgccaattatactgcggcccttttaattatgagatggaagcagcaggaggcaagctagttcaattgtccggtttgttaagccgcattgctcaagagcacccctgcctgcgccatcgatcgccacacggtgtgtgccagtctacatcgccggcctctttatcattgtgctagtagctgcttattaggcaaagctcaattacgcagctaagccagttgatatgcataaaagggaatgattactcttaaaccggacgcactggcgctttctgcttttttttaaaggaatgctatgaaaattggtacgtacgtagtactactactatgcatatcagtttttttcttcttcttttttttcttatacatatatcagtataccagtctgtatatatgtacacacacttcgttcttcagctacgacgtacaatactgctacaccccatgggctgcgggaactgttcgtgaaaagtgacgagatgaggcagcactgtggtagatattcttgcgagtagtggcaatgtcaccctcacacttttccttgtactgccattaatcccaatttgtccttatttatctgtttaccctctctttctctctcctcggccgggcccttttttttctttgcaacatacaccaccacaatattcttcaacactctcacctcctctcattcaatactgtctctcagcctttttttttcatagtgtgtgcggccgatctatgcacctcacctttcccttgctgcagttggaggaagtgtgctgcaggtggaagaagagaggggagaagctggttcccctctccatatctctcctccccagctccctccccctctcatagatcgatcacacagcctgcaggcacagacaagagttaggctgttctacctgatcatatgaccctccagcaattctctcatccacacacaaactgaagcaagaattattgcttatctatatcctgtctgtcctttcctctatttcccccctcccctttctatttccattgtgcagcttgttattagtagatagcagtggatcgatgtgtgatggaggaaacaagctagctagctagctaccagctgaagcagcagggagaagaaggatagagagagagagagagagagaaaacatcttcttcatccatagtctcggcctttcttcaccaggtcgtctgcagatctgtctcctgtgaccttccagaggtgaggatgagcaggtctctctagctcactgcgctacatgcccatgtatgagaagttctattttagaagacaaaaaggctttgatctgcagtcttcgttctcgtcttctgggttctggccttctcttgcttggcagtggcactattattatattatctatggttcttgagatttgagcaaataaagatcgcctttttttcctttaaaaaatctgtgcttcttgtgccgtatcatcatacatgcacacccacgcatttgtacagtggatcatgcatcctccatttgtgttcatgatcatgctgttgatttgcactgctccctttatcaataattttccgcagatgagaaatctacagtctcattattgtcccctctttctttgtcccaaggtaaaaagggaagaacagaacttccccatttttcccaaagattgcacatgcatagctggctggatcagagcacatcacactccgaaaccctaatcttctccctctcctcgtgcctttcccagaacaatatataatcctccgtccaagaaaaccctagccctaagattagtatcgaaagatcgcgatgcatattattcacagctcagccaccacaccaccatatgtagagatagatatacgtatatttctttgggaaaaaacggataataatccaactaattaatcaacgtttttctactgatttattcgcaggccaagctaggccaggaaggaaaa

SEQ ID NO: 78 - DNA, 1000 bp, Zea mays derived;
agtgaaggggaagcgctgcgctgccgtgaatggtaaggcgctgtttctttctctctgagtaattaagtttaatcctgcacggcggccatgcccatgcatgatgtatagctactgtatgtgctagctagtttgtgtgttttaattatatacatatatagctgttcttatctgtgtgtgcgttgctttgcttattactatgcttgtgtagtgtgttgtgcagtgatgtattactctaatccttgttaagatgtggaggcgacgacatggatttgagccctttgaccttaatgagctgtgggatcggacggcggagtcggtgaaggaaggaaggaaggaagcttcaggggggggggggagacgatgtcatgggagcccaatcgatctcagcaggttgattaagagctaaggagcaatctatctatctatctatctacctacctttcgctatatatatctatatagccgacatgaattatatatatcgactgcatctatcccctttctgcatgttgtgcaaaccaatactttggagtactaaatgtaatcgagccgagatcttgatctctcttcttttcatgattaattcttcgttctcgcaggatccatccatccatcatcatcatcatcatcagtcattagcacactatgcatgcatgcatgctttggcctttgcgatcagaaaacaaaacagccacctttaggccttgataaataaaatacacaagagccaatcaaaggcagcaggttcctacatgcatgcatgagtagtagtgtagtactaagctgatctcttgggccaattaaagggctgcatgcatgatctgcatcttatatcatatgtcataggcaccagtggcctatgctcttgcatatatgctccagatatatgcatgatcgtcagatgggagatcgagctagctagctagggacgagaggggagagattaataacgacgagcacacagttattagttgtttaaactatattatatatacataaa

SEQ ID NO: 79 - DNA, 17541 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccgctaacaataagctcagcctttttaccccagggtggtaggctgacacttatcaactatgttctttctataatcctcacatactatatgtgttctcttgaactgtctttaactgtcatcaaagccattgatacagcaagaaagaacggtttgtagagaggaaataacccaaattccaccagaaaatatttagcttcctgggagctagtgtgcaggctaaaggacaagggtggtttaggggtgataaatctaagaaaccagaatgttgttcttttattgaaacacttagataagttctatagaaatgttgatcttccttgggtggatctcatatggaaatcttattgcacttcaaagtctcttcacttagtttcaaatagaggctccttttggtggaaaaatattgtttccctggtagatgtttttagagggatgctcattgcacagtgcaaacaggaacctcactgctcttttggggatctgtgtaatggggaactaagtttcctaatcttttttgggcagcttataacaaagatgaatttgttaagatggcttgctccaagcctttggaagatgctttatgctaccaatgaatgctgaagcttatggggaatttttagttttgcaatctgaacttgacaatgtccatttaagtgaggggttgggtgatcattggagctatatttggaatgttgataagtattctgctcaaagattttaaaaaatgaattattcatgcttacagcctccaaggccgcttgtttggatctggaagacaaagcgtgtgatgaaaatcaaagtgtttgcttggctcctctctttagacagaattaatacaagggacatggtggattgcaggcactatgctaaggaaaatgatgatctcacctgtgttctttgctctgggggtataagagagataaggctacatctcttctttacctacccttttagtctccgatgttgacagtatttgggttttgattggtctccttatttaaatttcttccagatgattgttctagtgagaattcgttttggtacgaaggtttcctggagatcttctttacaactcctggtatatttggaagcaaagaaatggcttgatttttcataatgtacctccaacttttcatggatggaaagttcagttcaggaaagagcttcttctacatatgtgtagaatgaaggagcctctcaagcaattagtttttgattagttacaaattttgtaattattttgtgggtttctgtttttcctagtaagatgtaaatatttctttttatacaagctatactggtaggcaaatgcctggcagtaatttgtcaaaaaaaaatgaactttgtatttatcgtattatgttgttaatctagtatttaagtatcaaatgcaaattgcagttggggtgtcaaggatatgtgtgttagtgtgtgtattagtgtgctaaggacattttagtcttttcccatatctttgtatacaatatattcccctctagggcaaaatcaatggatcaacgatttatccccaaatccccaaaattataacatctgacatgtgaaccgtatgcacctacacttatccgctactacggtctgttaatattcaggcacaacacaacttacacgatatacaaaatgcatcaagaaaatcatcgtaagatcgattattattatgcatcaagaaaatcatcgtaagatcgattattattattaactgtttatagttaacaacagctactacgatcctctccatttctaccagcattcgaagattcacactctttgcaagccaaaaggccatgacccaaccaaacctcacctacaccccactagtcatggtaacacacaagaaccgtgtcatcctcgccacgaccaccaccaccaccatgtcgtcgccttcctctcgccacccctcgtcaccacgctctctacaaatgccagagctccggccacccccaccaccacccaagaagcctgcgccgccgaccggcatcgcgacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaattaattaacagacataaatcattgtgattgatatcaagaaccgaaagcatgcaaggtgttaaattgcataaaaatggagttggataagtgtttcatcatcaccgagtatatgtacgtacatgttagtgattatcgtgtgaaattaccatggaaatgaattctaagtctttaatttaagtacatttatcttcgtttcttttttacaaatagccatgcttatttttttttaaaaaaaactaggaagatagtccgcgcatatgcgcgagcatcttatttaatattgtttgaatttttattatggaagcttatatgtgggtgattttttctttaaatattctgactctattctaaatctatttccgtcgataatttatttaagattgcttatgatttttttctaattacccttgcaacgtataaatcacttttattaggtcaattcttacgataaagtatattttcattacatggattctcatatatatataagtttaacatggtatgcttctcctagttaaccgaatttatagtggaatatccatgtaccaattatatttaatactggatggataccccacgtattgctgcggaatttttatatccttcggagcattcccctattgtcatgcataaagcaatattcctcattcgagtataaaaagataacatgaaaaattatatgaaaaattataggaaccaaaaactgaaaacaaataaccaagtatctgtaattctgagctggaattgcatagcatgaaaaaaaattatgcgaggttaacgtcaagaagattaaatataacacgtaatatgggacaaaataaaatggattactcttgaagtataaaattggatgcaaaagcatatacctaacaaaaaaaactaataaatttaatttggcattcagtttagagggttaaaaatgtacgatgcaaaatatttttcagcatgaggtcccaacgaactgaaatatgagcgggtgactgataactcgtacttcagattacctacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 80 - DNA, 2000 bp, Oryza sativa derived;
gctaacaataagctcagcctttttaccccagggtggtaggctgacacttatcaactatgttctttctataatcctcacatactatatgtgttctcttgaactgtctttaactgtcatcaaagccattgatacagcaagaaagaacggtttgtagagaggaaataacccaaattccaccagaaaatatttagcttcctgggagctagtgtgcaggctaaaggacaagggtggtttaggggtgataaatctaagaaaccagaatgttgttcttttattgaaacacttagataagttctatagaaatgttgatcttccttgggtggatctcatatggaaatcttattgcacttcaaagtctcttcacttagtttcaaatagaggctccttttggtggaaaaatattgtttccctggtagatgtttttagagggatgctcattgcacagtgcaaacaggaacctcactgctcttttggggatctgtgtaatggggaactaagtttcctaatcttttttgggcagcttataacaaagatgaatttgttaagatggcttgctccaagcctttggaagatgctttatgctaccaatgaatgctgaagcttatggggaatttttagttttgcaatctgaacttgacaatgtccatttaagtgaggggttgggtgatcattggagctatatttggaatgttgataagtattctgctcaaagattttaaaaaatgaattattcatgcttacagcctccaaggccgcttgtttggatctggaagacaaagcgtgtgatgaaaatcaaagtgtttgcttggctcctctctttagacagaattaatacaagggacatggtggattgcaggcactatgctaaggaaaatgatgatctcacctgtgttctttgctctgggggtataagagagataaggctacatctcttctttacctacccttttagtctccgatgttgacagtatttgggttttgattggtctccttatttaaatttcttccagatgattgttctagtgagaattcgttttggtacgaaggtttcctggagatcttctttacaactcctggtatatttggaagcaaagaaatggcttgatttttcataatgtacctccaacttttcatggatggaaagttcagttcaggaaagagcttcttctacatatgtgtagaatgaaggagcctctcaagcaattagtttttgattagttacaaattttgtaattattttgtgggtttctgtttttcctagtaagatgtaaatatttctttttatacaagctatactggtaggcaaatgcctggcagtaatttgtcaaaaaaaaatgaactttgtatttatcgtattatgttgttaatctagtatttaagtatcaaatgcaaattgcagttggggtgtcaaggatatgtgtgttagtgtgtgtattagtgtgctaaggacattttagtcttttcccatatctttgtatacaatatattcccctctagggcaaaatcaatggatcaacgatttatccccaaatccccaaaattataacatctgacatgtgaaccgtatgcacctacacttatccgctactacggtctgttaatattcaggcacaacacaacttacacgatatacaaaatgcatcaagaaaatcatcgtaagatcgattattattatgcatcaagaaaatcatcgtaagatcgattattattattaactgtttatagttaacaacagctactacgatcctctccatttctaccagcattcgaagattcacactctttgcaagccaaaaggccatgacccaaccaaacctcacctacaccccactagtcatggtaacacacaagaaccgtgtcatcctcgccacgaccaccaccaccaccatgtcgtcgccttcctctcgccacccctcgtcaccacgctctctacaaatgccagagctccggccacccccaccaccacccaagaagcctgcgccgccgaccggcatcgcgac

SEQ ID NO: 81 - DNA, 1000 bp, Oryza sativa derived;
ttaattaacagacataaatcattgtgattgatatcaagaaccgaaagcatgcaaggtgttaaattgcataaaaatggagttggataagtgtttcatcatcaccgagtatatgtacgtacatgttagtgattatcgtgtgaaattaccatggaaatgaattctaagtctttaatttaagtacatttatcttcgtttcttttttacaaatagccatgcttatttttttttaaaaaaaactaggaagatagtccgcgcatatgcgcgagcatcttatttaatattgtttgaatttttattatggaagcttatatgtgggtgattttttctttaaatattctgactctattctaaatctatttccgtcgataatttatttaagattgcttatgatttttttctaattacccttgcaacgtataaatcacttttattaggtcaattcttacgataaagtatattttcattacatggattctcatatatatataagtttaacatggtatgcttctcctagttaaccgaatttatagtggaatatccatgtaccaattatatttaatactggatggataccccacgtattgctgcggaatttttatatccttcggagcattcccctattgtcatgcataaagcaatattcctcattcgagtataaaaagataacatgaaaaattatatgaaaaattataggaaccaaaaactgaaaacaaataaccaagtatctgtaattctgagctggaattgcatagcatgaaaaaaaattatgcgaggttaacgtcaagaagattaaatataacacgtaatatgggacaaaataaaatggattactcttgaagtataaaattggatgcaaaagcatatacctaacaaaaaaaactaataaatttaatttggcattcagtttagagggttaaaaatgtacgatgcaaaatatttttcagcatgaggtcccaacgaactgaaatatgagcgggtgactgataactcgtacttcaga

SEQ ID NO: 82 - DNA, 18116 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctaatttgagagcagtccagtgcggaaggacgaacgggcgtggggggagctaggtatgaaccgaatagggtgggccatgagacggcggacggcggaggatctcctctgcaaagatgcacggtgggatgggcaggaccttacctcacgcggcggacggatgttgccgacgcctgctcctttctccctgcagcggaccgacgtcgcgcgcgacaggtgacgaggaacgacggtgagggcgtgaggcgggggcacccgaggactggtgggggcgtatgggtgctggtcagtgcctgatccagacttctcactgcatcgtcacggtcttcctccccatgcctcgaaagcatcgcggcgcgcgcgcggcgagggaggagctcggcggcgccttggttcaggcgagacaggggcgggggctatgtgcctgtgggggaggggaacccgtggtggggcatcaggaggcgggtgtagtgggcgggggcatggaggtaggagagcgcgacaggggcacggacgccgaaccgggggatggggcacatattgcgcgggggagggcgagattgccgcaggggacggcgggattgccgcgggggagggagattgtcgcggtgacgccgagattgccgctggggcgagcgccgagattgccgggggagggcgaggcgggtgggatgcggggtgccccacggcagaaccgtgcaccactgtcgggctgtgaacgtctacaatacttacttatgtagtagtagatatatatatatatatatatataatgtaaaacaatattttaattataatgtaaacagtgttttacatgattatatacaagatcgactagatagagtttaaggccatatctagcggaacaggtatataagcgtgcaaaacaatgttttgttttgtacgctacactgtttttagagtggagttaactaaaaccttaacttttttttgcaaataaatctctaaataatgtcgtactgtatacactcgagatttccatcgcacaagacacgaaaaaatcccgatcaatttaacgaacattgttttgcattatagattatattgtttacagaatgaagttaactaaaaccttaaccttttgcagataaatctctaaatagtgccgtactgtatacactcgagatttccaccgcacaagacatgagaaaattccggtcgatttgacaaagactgggtgttattaattagaggaagcagatccagccacatgttgtctcacatctgatcccccacgtatagtcgtatacgtttggcccaaacctagctcgatccatgtatgaaacacgtctcgtctcgccttctacctcctttttctatcacaggagattaaagtgagagagagagggcgctcaatgaactgcggcattgaacaatggagctgcaagagcaatgatgcactagctagtgtaatgcagtgcatgcatggtagattggtagcttgcctttgcagtttgcaccaggcaccagcagcagctagaagacgacagacgacaggggtttggctgctaggttgcggaagggcagttaccagttgccacaaggggagcctggccctctgcatcctcctcatgatagctctgtctctctctctcacagacacacacacagagactcttccaaattccgaagcggccaatgcaatgcaagagccagcccccggccgtgtgtcaacttcacttgtctctctccaaaagatatcgtatcacccatggccatgacccccctcccccagccccaacctatatcacctagcgcagctacgctctcttctcccgctctcgctctctgcatgctagctaccttctagctatctagcctctaggtccaatgcactccctccttataaacaaggaaccctccttcgcctctcttgccatagaccggacaccggagaggtcactgcacaggagcgctcaggaaggccgctgcgctgagatagaggcaaggcggccaaagcgggcggcggtggagcgggaggaggcagcggcagcggcagcgtggctgcgccggcggtgtgccgccccagcggctcgcggtggacgccgacgccggagcagatcaggaagctgaaggagctctactacggctgcggcatccggtcgcccagctcggagcagatccagcgcatcaccgccaagctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccttcaggtatgtgcgtcagtgcgtgtggtgtgggtagtatatatatatatatatatatatatatatatatatatatatatatatatatatatatatatatggcctctctttgcattggcacgccaatcggccatcgagatccaatcatatatatcatccaaacgtatagtattagtacatctgtacatgtgactgcaaactgacgtgcacgcgtgtgcaccgtcgtcatcactgatcaggcgcggcgcctccctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaaagagcaacgcgagctaccactgggacgtgcgttgctgtcattgtcctaggttagtagctagtgccagttactagtaagcatcaggcataggagtatgtagtagaagcatgtctggagaaaggcaatagctagcgtttgggagatctctggcggtactattattagatagcgaatttgcatactatgcagcatgcatgttgccggccgggcgggctttagactccagctactgcatgcgtgcatgcggtggtcctcatgtatgtcggcatgtgtgcgtgtgtgtgtggcagcagcagcagcagtgaattctagtgcagtggtggtggttgtaacgtgtagtttgggggcaggggcacagttgtgtcgaacttgtgcggttgtcccttccttttgtgacttccagaaaagggaatgaggcctgcctgcgtgtctgcttttccatgctcacctcgcctgttgtctgttgagacttcactcagccctgttggtgccttgtagttccagttccagagcatatgcaggtgcaggaatggcatctctaccactgctttcgacttgttggcttgttttcttctatgatactagtgtacttggattgaatgatcacattttttgctggcctcgtatctttgaaatgatcatgttaatttggttacacataagacgataagggtaggtagttcaatgctattagaaaactaggtatttttagttatattttaatccaggaaaaaatatataaaaactaatcgtgatatatagaaatacgcatatgcaaacttagtataataattatgaatacaatagatagtaacctgattgtatatacttttaagggaaaatagatatggcaatgggcctcgatcttcgattctctgcggagaattcttccattaaaggatagggatgaggaaacttcgtccccccacggagatgtaaacgagaaaattttctaccccgatgggtaaaaccagagatggggtgaggaaacatttcccatacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 83 - DNA, 2581 bp, Zea mays derived;
tttgagagcagtccagtgcggaaggacgaacgggcgtggggggagctaggtatgaaccgaatagggtgggccatgagacggcggacggcggaggatctcctctgcaaagatgcacggtgggatgggcaggaccttacctcacgcggcggacggatgttgccgacgcctgctcctttctccctgcagcggaccgacgtcgcgcgcgacaggtgacgaggaacgacggtgagggcgtgaggcgggggcacccgaggactggtgggggcgtatgggtgctggtcagtgcctgatccagacttctcactgcatcgtcacggtcttcctccccatgcctcgaaagcatcgcggcgcgcgcgcggcgagggaggagctcggcggcgccttggttcaggcgagacaggggcgggggctatgtgcctgtgggggaggggaacccgtggtggggcatcaggaggcgggtgtagtgggcgggggcatggaggtaggagagcgcgacaggggcacggacgccgaaccgggggatggggcacatattgcgcgggggagggcgagattgccgcaggggacggcgggattgccgcgggggagggagattgtcgcggtgacgccgagattgccgctggggcgagcgccgagattgccgggggagggcgaggcgggtgggatgcggggtgccccacggcagaaccgtgcaccactgtcgggctgtgaacgtctacaatacttacttatgtagtagtagatatatatatatatatatatataatgtaaaacaatattttaattataatgtaaacagtgttttacatgattatatacaagatcgactagatagagtttaaggccatatctagcggaacaggtatataagcgtgcaaaacaatgttttgttttgtacgctacactgtttttagagtggagttaactaaaaccttaacttttttttgcaaataaatctctaaataatgtcgtactgtatacactcgagatttccatcgcacaagacacgaaaaaatcccgatcaatttaacgaacattgttttgcattatagattatattgtttacagaatgaagttaactaaaaccttaaccttttgcagataaatctctaaatagtgccgtactgtatacactcgagatttccaccgcacaagacatgagaaaattccggtcgatttgacaaagactgggtgttattaattagaggaagcagatccagccacatgttgtctcacatctgatcccccacgtatagtcgtatacgtttggcccaaacctagctcgatccatgtatgaaacacgtctcgtctcgccttctacctcctttttctatcacaggagattaaagtgagagagagagggcgctcaatgaactgcggcattgaacaatggagctgcaagagcaatgatgcactagctagtgtaatgcagtgcatgcatggtagattggtagcttgcctttgcagtttgcaccaggcaccagcagcagctagaagacgacagacgacaggggtttggctgctaggttgcggaagggcagttaccagttgccacaaggggagcctggccctctgcatcctcctcatgatagctctgtctctctctctcacagacacacacacagagactcttccaaattccgaagcggccaatgcaatgcaagagccagcccccggccgtgtgtcaacttcacttgtctctctccaaaagatatcgtatcacccatggccatgacccccctcccccagccccaacctatatcacctagcgcagctacgctctcttctcccgctctcgctctctgcatgctagctaccttctagctatctagcctctaggtccaatgcactccctccttataaacaaggaaccctccttcgcctctcttgccatagaccggacaccggagaggtcactgcacaggagcgctcaggaaggccgctgcgctgagatagaggcaaggcggccaaagcgggcggcggtggagcgggaggaggcagcggcagcggcagcgtggctgcgccggcggtgtgccgccccagcggctcgcggtggacgccgacgccggagcagatcaggaagctgaaggagctctactacggctgcggcatccggtcgcccagctcggagcagatccagcgcatcaccgccaagctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccttcaggtatgtgcgtcagtgcgtgtggtgtgggtagtatatatatatatatatatatatatatatatatatatatatatatatatatatatatatatatggcctctctttgcattggcacgccaatcggccatcgagatccaatcatatatatcatccaaacgtatagtattagtacatctgtacatgtgactgcaaactgacgtgcacgcgtgtgcaccgtcgtcatcactgatcaggcgcggcgcctccct

SEQ ID NO: 84 - DNA, 1000 bp, Zea mays derived;
gagcaacgcgagctaccactgggacgtgcgttgctgtcattgtcctaggttagtagctagtgccagttactagtaagcatcaggcataggagtatgtagtagaagcatgtctggagaaaggcaatagctagcgtttgggagatctctggcggtactattattagatagcgaatttgcatactatgcagcatgcatgttgccggccgggcgggctttagactccagctactgcatgcgtgcatgcggtggtcctcatgtatgtcggcatgtgtgcgtgtgtgtgtggcagcagcagcagcagtgaattctagtgcagtggtggtggttgtaacgtgtagtttgggggcaggggcacagttgtgtcgaacttgtgcggttgtcccttccttttgtgacttccagaaaagggaatgaggcctgcctgcgtgtctgcttttccatgctcacctcgcctgttgtctgttgagacttcactcagccctgttggtgccttgtagttccagttccagagcatatgcaggtgcaggaatggcatctctaccactgctttcgacttgttggcttgttttcttctatgatactagtgtacttggattgaatgatcacattttttgctggcctcgtatctttgaaatgatcatgttaatttggttacacataagacgataagggtaggtagttcaatgctattagaaaactaggtatttttagttatattttaatccaggaaaaaatatataaaaactaatcgtgatatatagaaatacgcatatgcaaacttagtataataattatgaatacaatagatagtaacctgattgtatatacttttaagggaaaatagatatggcaatgggcctcgatcttcgattctctgcggagaattcttccattaaaggatagggatgaggaaacttcgtccccccacggagatgtaaacgagaaaattttctaccccgatgggtaaaaccagagatggggtgaggaaacatttcccata

SEQ ID NO: 85 - DNA, 17524 bp, Artificial sequence; identical to SEQ ID NO: 37
  sythesized vector

SEQ ID NO: 86 - DNA, 1920 bp, Zea mays derived;; identical to SEQ ID NO: 38

SEQ ID NO: 87 - DNA, 1069 bp, Zea mays derived;; identical to SEQ ID NO: 39

SEQ ID NO: 88 - DNA, 22402 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttaagccaatttacggcgatcgcggaccgcaagtatgtgtgcgctctgtcggaccgcaagtatgtgtgcgctctgtcggaagctacataggattaccataacagatagctgacggcctacaaaaaaagatagaatacaggagaacatcacacagataaaaacatatcacccttgtactagcagggaggcggtgcttgctggattttagatcagttgcttgctggattttagatcagtacacagtcctgccatcaccatccaggatcatatccttgaaagccccaccactagggatcataggcaacacatgctcctggtgtgggacgattatatccaagaggtacggccctggagtctcgagcatcttctttatcgctgcgcggacttcgttcttctttgtcacacggaccgctggaatgttgaaccctttggcgatcgtcacgaaatctggatatatctcactttcattctctgggtttcccaagtaggtgtgagccctattcgccttatagaacctgtcctccaactgcaccaccatccccaggtgctggttgtttagcacaaagaccttcaccgggaggttctcaattcggatcatagctagctcctgaacgttcatgagaaagctaccatctccatcgatgtcaacaacagtaacacctgggttggccacagaagcaccagcagcagccggcaaaccaaatcccatagccccaagaccagctgaagacaaccactgccttggccgcttgtaagtgtagtactgtgccgcccacatctggtgctgcccaacacctgtgccgatgatggcctcgcctttcgtcagctcatcaagaacctgaatagcatattgtggctggatctcctcattagatgttttatacccaagggggaattccctcttctgctgatccaacagagcgcacacatacttgacagagcgcacacatacttggggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacaagtatgtgtgcgctctgtgttttagagctagaaatagcaagttaaaataaggctagtccgttatcaacttgaaaaagtggcaccgagtcggtgctttttttttcggaccggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgagcaagccactgtcgtccgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 89 - DNA, 5738 bp, Zea mays derived;; identical to SEQ ID NO: 50

SEQ ID NO: 90 - DNA, 1152 bp, Zea mays derived;; identical to SEQ ID NO: 24

SEQ ID NO: 91 - DNA, 375 bp, Oryza sativa derived;; identical to SEQ ID NO: 9

SEQ ID NO: 92 - DNA, 3332 bp, Zea mays derived;
gtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcag

SEQ ID NO: 93 - DNA, 30 bp, Artificial sequence
  synthesized vector component
agcagcccgccgaagaagaagaggaaggtg

SEQ ID NO: 94 - DNA, 20 bp, Artificial sequence
  synthesized vector component
acagagcgcacacatacttg

SEQ ID NO: 95 - DNA, 20 bp, Artificial sequence
  synthesized vector component
caagtatgtgtgcgctctgt

SEQ ID NO: 96 - DNA, 20 bp, Artificial sequence
  synthesized vector component
acagagcgcacacatacttg

SEQ ID NO: 97 - DNA, 839 bp, Artificial sequence
  synthesized vector component
cggaagctacataggattaccataacagatagctgacggcctacaaaaaaagatagaatacaggagaacatcacacagataaaaacatatcacccttgtactagcagggaggcggtgcttgctggattttagatcagttgcttgctggattttagatcagtacacagtcctgccatcaccatccaggatcatatccttgaaagccccaccactagggatcataggcaacacatgctcctggtgtgggacgattatatccaagaggtacggccctggagtctcgagcatcttctttatcgctgcgcggacttcgttcttctttgtcacacggaccgctggaatgttgaaccctttggcgatcgtcacgaaatctggatatatctcactttcattctctgggtttcccaagtaggtgtgagccctattcgccttatagaacctgtcctccaactgcaccaccatccccaggtgctggttgtttagcacaaagaccttcaccgggaggttctcaattcggatcatagctagctcctgaacgttcatgagaaagctaccatctccatcgatgtcaacaacagtaacacctgggttggccacagaagcaccagcagcagccggcaaaccaaatcccatagccccaagaccagctgaagacaaccactgccttggccgcttgtaagtgtagtactgtgccgcccacatctggtgctgcccaacacctgtgccgatgatggcctcgcctttcgtcagctcatcaagaacctgaatagcatattgtggctggatctcctcattagatgttttatacccaagggggaattccctcttctgctgatcca

SEQ ID NO: 98 - DNA, 106 bp, Artificial sequence
  synthesized vector component
acaagtatgtgtgcgctctgtgttttagagctagaaatagcaagttaaaataaggctagtccgttatcaacttgaaaaagtggcaccgagtcggtgcttttttttt

SEQ ID NO: 99 - DNA, 12 bp, Artificial sequence
  synthesized vector component
gttttagagcta

SEQ ID NO: 100 - DNA, 69 bp, Artificial sequence; identical to SEQ ID NO: 8
  synthesized vector component

SEQ ID NO: 101 - DNA, 375 bp, Artificial sequence; identical to SEQ ID NO: 9
  synthesized vector component

SEQ ID NO: 102 - DNA, 4170 bp, Artificial sequence; identical to SEQ ID NO: 4
  synthesized vector component

SEQ ID NO: 103 - DNA, 175 bp, Zea mays derived;
  misc_feature (26)..(26): n is a, c, g, or t
tgggaggccggcaagccactgtcgantcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 104 - DNA, 157 bp, Zea mays derived;
tgggaggccggaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 105 - DNA, 173 bp, Zea mays derived;
tgggaggccggcaagccactgtcgtcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 106 - DNA, 175 bp, Zea mays derived;; identical to SEQ ID NO: 103
  misc_feature (26)..(26): n is a, c, g, or t

SEQ ID NO: 107 - DNA, 174 bp, Zea mays derived;
tgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 108 - DNA, 175 bp, Zea mays derived;; identical to SEQ ID NO: 103
  misc_feature (26)..(26): n is a, c, g, or t

SEQ ID NO: 109 - DNA, 171 bp, Zea mays derived;
tgggaggccggcaagccactgttcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 110 - DNA, 173 bp, Zea mays derived;; identical to SEQ ID NO: 105

SEQ ID NO: 111 - DNA, 172 bp, Zea mays derived;
tgggaggccggcaagccactgtctcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 112 - DNA, 175 bp, Zea mays derived;; identical to SEQ ID NO: 103
  misc_feature (26)..(26): n is a, c, g, or t

SEQ ID NO: 113 - DNA, 171 bp, Zea mays derived;
tgggaggccggcaagccactgtccgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 114 - DNA, 170 bp, Zea mays derived;
tgggaggccggcaagccactgtcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 115 - DNA, 175 bp, Zea mays derived;; identical to SEQ ID NO: 103
  misc_feature (26)..(26): n is a, c, g, or t

SEQ ID NO: 116 - DNA, 175 bp, Zea mays derived;; identical to SEQ ID NO: 103
  misc_feature (26)..(26): n is a, c, g, or t

SEQ ID NO: 117 - DNA, 168 bp, Zea mays derived;
tgggaggccggcaagccactgtcgaaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 118 - DNA, 172 bp, Zea mays derived;; identical to SEQ ID NO: 111

SEQ ID NO: 119 - DNA, 174 bp, Zea mays derived;; identical to SEQ ID NO: 107

SEQ ID NO: 120 - DNA, 173 bp, Zea mays derived;; identical to SEQ ID NO: 105

SEQ ID NO: 121 - DNA, 175 bp, Zea mays derived;; identical to SEQ ID NO: 103
  misc_feature (26)..(26): n is a, c, g, or t

SEQ ID NO: 122 - DNA, 174 bp, Zea mays derived;; identical to SEQ ID NO: 107

SEQ ID NO: 123 - DNA, 166 bp, Zea mays derived;
tgggaggccggcaagccactgtcgggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 124 - DNA, 173 bp, Zea mays derived;; identical to SEQ ID NO: 105

SEQ ID NO: 125 - DNA, 173 bp, Zea mays derived;; identical to SEQ ID NO: 105

SEQ ID NO: 126 - DNA, 173 bp, Zea mays derived;
tgggaggccggcaagccactgtcgacgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 127 - DNA, 173 bp, Zea mays derived;; identical to SEQ ID NO: 126

SEQ ID NO: 128 - DNA, 175 bp, Zea mays derived;; identical to SEQ ID NO: 103
  misc_feature (26)..(26): n is a, c, g, or t

SEQ ID NO: 129 - DNA, 173 bp, Zea mays derived;; identical to SEQ ID NO: 105

SEQ ID NO: 130 - DNA, 175 bp, Zea mays derived;; identical to SEQ ID NO: 103
  misc_feature (26)..(26): n is a, c, g, or t

SEQ ID NO: 131 - DNA, 172 bp, Zea mays derived;
tgggaggccggcaagccactgtcgagaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 132 - DNA, 175 bp, Zea mays derived;; identical to SEQ ID NO: 103
  misc_feature (26)..(26): n is a, c, g, or t

SEQ ID NO: 133 - DNA, 174 bp, Zea mays derived;; identical to SEQ ID NO: 107

SEQ ID NO: 134 - DNA, 171 bp, Zea mays derived;; identical to SEQ ID NO: 113

SEQ ID NO: 135 - DNA, 172 bp, Zea mays derived;; identical to SEQ ID NO: 111

SEQ ID NO: 136 - DNA, 173 bp, Zea mays derived;; identical to SEQ ID NO: 126

SEQ ID NO: 137 - DNA, 173 bp, Zea mays derived;; identical to SEQ ID NO: 105

SEQ ID NO: 138 - DNA, 175 bp, Zea mays derived;; identical to SEQ ID NO: 103
  misc_feature (26)..(26): n is a, c, g, or t

SEQ ID NO: 139 - DNA, 173 bp, Zea mays derived;; identical to SEQ ID NO: 126

SEQ ID NO: 140 - DNA, 173 bp, Zea mays derived;; identical to SEQ ID NO: 105

SEQ ID NO: 141 - DNA, 175 bp, Zea mays derived;; identical to SEQ ID NO: 103
  misc_feature (26)..(26): n is a, c, g, or t

SEQ ID NO: 142 - DNA, 173 bp, Zea mays derived;; identical to SEQ ID NO: 126

SEQ ID NO: 143 - DNA, 175 bp, Zea mays derived;; identical to SEQ ID NO: 103
  misc_feature (26)..(26): n is a, c, g, or t

SEQ ID NO: 144 - DNA, 174 bp, Zea mays derived;; identical to SEQ ID NO: 107

SEQ ID NO: 145 - DNA, 175 bp, Zea mays derived;; identical to SEQ ID NO: 103
  misc_feature (26)..(26): n is a, c, g, or t

SEQ ID NO: 146 - DNA, 173 bp, Zea mays derived;; identical to SEQ ID NO: 105

SEQ ID NO: 147 - DNA, 172 bp, Zea mays derived;; identical to SEQ ID NO: 111

SEQ ID NO: 148 - DNA, 170 bp, Zea mays derived;; identical to SEQ ID NO: 114

SEQ ID NO: 149 - DNA, 171 bp, Zea mays derived;
tgggaggccggcaagccactgtcgaaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 150 - DNA, 175 bp, Zea mays derived;; identical to SEQ ID NO: 103
  misc_feature (26)..(26): n is a, c, g, or t

SEQ ID NO: 151 - DNA, 172 bp, Zea mays derived;
tgggaggccggcaagccactgtcgcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 152 - DNA, 173 bp, Zea mays derived;; identical to SEQ ID NO: 105

SEQ ID NO: 153 - DNA, 175 bp, Zea mays derived;; identical to SEQ ID NO: 103
  misc_feature (26)..(26): n is a, c, g, or t

SEQ ID NO: 154 - DNA, 173 bp, Zea mays derived;; identical to SEQ ID NO: 126

SEQ ID NO: 155 - DNA, 173 bp, Zea mays derived;; identical to SEQ ID NO: 105

SEQ ID NO: 156 - DNA, 175 bp, Zea mays derived;; identical to SEQ ID NO: 103
  misc_feature (26)..(26): n is a, c, g, or t

SEQ ID NO: 157 - DNA, 173 bp, Zea mays derived;; identical to SEQ ID NO: 105

SEQ ID NO: 158 - DNA, 175 bp, Zea mays derived;; identical to SEQ ID NO: 103
  misc_feature (26)..(26): n is a, c, g, or t

SEQ ID NO: 159 - DNA, 175 bp, Zea mays derived;; identical to SEQ ID NO: 103
  misc_feature (26)..(26): n is a, c, g, or t

SEQ ID NO: 160 - DNA, 158 bp, Zea mays derived;
tgggaggccggcaagccactgaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 161 - DNA, 170 bp, Zea mays derived;; identical to SEQ ID NO: 114

SEQ ID NO: 162 - DNA, 173 bp, Zea mays derived;; identical to SEQ ID NO: 105

SEQ ID NO: 163 - DNA, 175 bp, Zea mays derived;; identical to SEQ ID NO: 103
  misc_feature (26)..(26): n is a, c, g, or t

SEQ ID NO: 164 - DNA, 173 bp, Zea mays derived;; identical to SEQ ID NO: 105

SEQ ID NO: 165 - DNA, 175 bp, Zea mays derived;; identical to SEQ ID NO: 103
  misc_feature (26)..(26): n is a, c, g, or t

SEQ ID NO: 166 - DNA, 171 bp, Zea mays derived;; identical to SEQ ID NO: 113

SEQ ID NO: 167 - DNA, 175 bp, Zea mays derived;; identical to SEQ ID NO: 103
  misc_feature (26)..(26): n is a, c, g, or t

SEQ ID NO: 168 - DNA, 174 bp, Zea mays derived;; identical to SEQ ID NO: 107

SEQ ID NO: 169 - DNA, 172 bp, Zea mays derived;; identical to SEQ ID NO: 111

SEQ ID NO: 170 - DNA, 173 bp, Zea mays derived;; identical to SEQ ID NO: 126

SEQ ID NO: 171 - DNA, 175 bp, Zea mays derived;; identical to SEQ ID NO: 103
  misc_feature (26)..(26): n is a, c, g, or t

SEQ ID NO: 172 - DNA, 174 bp, Zea mays derived;; identical to SEQ ID NO: 107

SEQ ID NO: 173 - DNA, 175 bp, Zea mays derived;; identical to SEQ ID NO: 103
  misc_feature (26)..(26): n is a, c, g, or t

SEQ ID NO: 174 - DNA, 173 bp, Zea mays derived;; identical to SEQ ID NO: 126

SEQ ID NO: 175 - DNA, 173 bp, Zea mays derived;; identical to SEQ ID NO: 105

SEQ ID NO: 176 - DNA, 170 bp, Zea mays derived;; identical to SEQ ID NO: 114

SEQ ID NO: 177 - DNA, 172 bp, Zea mays derived;; identical to SEQ ID NO: 111

SEQ ID NO: 178 - DNA, 170 bp, Zea mays derived;; identical to SEQ ID NO: 114

SEQ ID NO: 179 - DNA, 174 bp, Zea mays derived;; identical to SEQ ID NO: 107

SEQ ID NO: 180 - DNA, 175 bp, Zea mays derived;; identical to SEQ ID NO: 103
  misc_feature (26)..(26): n is a, c, g, or t

SEQ ID NO: 181 - DNA, 159 bp, Zea mays derived;
tgggaggccggcaaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 182 - DNA, 175 bp, Zea mays derived;; identical to SEQ ID NO: 103
  misc_feature (26)..(26): n is a, c, g, or t

SEQ ID NO: 183 - DNA, 175 bp, Zea mays derived;; identical to SEQ ID NO: 103
  misc_feature (26)..(26): n is a, c, g, or t

SEQ ID NO: 184 - DNA, 160 bp, Zea mays derived;
tgggaggccggcaagccaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgata

SEQ ID NO: 185 - DNA, 174 bp, Zea mays derived;; identical to SEQ ID NO: 107

SEQ ID NO: 186 - DNA, 29426 bp, Zea mays derived;
tcacctagatccttttgatccggaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttaagccaatttacggcgatcgcgagatgggctaccgcgcacttccttataagctaaggcatggcacagatttccaagtcaaaagtgtgataaatcaacatcttccacgaaagtgatcagaaaagatgtggtccaaaagcctccgcgcactcacgaaaagccgagtgcgcgtcgggggccaccacgcggggtaatattataacccgcgtggaggccccccgaccacacaccgaacagggcccacacgatacgctacgctcccgtgggaacacaagggccctgttctcccgccaaaacctgccctatataaagcattggacacattgcatttgcagtgtgcagaattcacacctccacgcagggtagagcatagagttttctggcacaccccgttttttcgctaaggacctgccggacttctgttcactaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctgctctagatccccgaatttccccgaccgttcaaacatttggcaataactgtcctagcgcggacggcgtacagtttctataaatgtaatatctcagggtgttgtatttcgttttccgatgtcattgtgtaagggttgttttttgttataatttggtttgtctttgctcgtagccgagcctctgtaatcgaatgacatgagataaataaaatattattttacggacccggaagctacataggattaccataacagatagctgacggcctacaaaaaaagatagaatacaggagaacatcacacagataaaaacatatcacccttgtactagcagggaggcggtgcttgctggattttagatcagttgcttgctggattttagatcagtacacagtcctgccatcaccatccaggatcatatccttgaaagccccaccactagggatcataggcaacacatgctcctggtgtgggacgattatatccaagaggtacggccctggagtctcgagcatcttctttatcgctgcgcggacttcgttcttctttgtcacacggaccgctggaatgttgaaccctttggcgatcgtcacgaaatctggatatatctcactttcattctctgggtttcccaagtaggtgtgagccctattcgccttatagaacctgtcctccaactgcaccaccatccccaggtgctggttgtttagcacaaagaccttcaccgggaggttctcaattcggatcatagctagctcctgaacgttcatgagaaagctaccatctccatcgatgtcaacaacagtaacacctgggttggccacagaagcaccagcagcagccggcaaaccaaatcccatagccccaagaccagctgaagacaaccactgccttggccgcttgtaagtgtagtactgtgccgcccacatctggtgctgcccaacacctgtgccgatgatggcctcgcctttcgtcagctcatcaagaacctgaatagcatattgtggctggatctcctcattagatgttttatacccaagggggaattccctcttctgctgatccacgagatgggctaccgcgcacttccttataagctaaggcatggcacagatttccaagtcaaaagtgtgataaatcaacatcttccacgaaagtgatcagaaaagatgtggtccaaaagcctccgcgcactcacgaaaagccgagtgcgcgtcgggggccaccacgcggggtaatattataacccgcgtggaggccccccgaccacacaccgaacagggcccacacgatacgctacgctcccgtgggaacacaagggccctgttctcccgccaaaacctgccctatataaagcattggacacattgcatttgcagtgtgcagaattcacacctccacgcagggtagagcatagagttttctggcacaccccgttttttcgctaaggacctgccggacttctgttcactaccgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacaagtatgtgtgcgctctgtgttttagagctagaaatagcaagttaaaataaggctagtccgttatcaacttgaaaaagtggcaccgagtcggtgctttttttttcggaccggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgactatctatgttaaaatattagatttttcatataagtcagatgttttaggaccatctctatcgttgtgtgatattgatacttatgaatcatgataatattttattatggttttttattgttgggttatttattatacattataagatcaccttatttaaccagaacaaggaataacaacttgagaaaacagtacaaccaaaaggactattatgactactgttctggctaattaattagagaagttagtgtgtgagaaccttacccaaaagggacaagtggagagtagttactcaagtatagagaggttctcgggctgatctgctctatggtagcttttcagacgagatattcctataccacctctgcttgaaatcgtagcgggttttctcatgctactgcaactttgtaaaggtctcgtagtgaatcctgtcctacctcctataaagaggtgaatgatctagctaacctgaggcaaatgagaaatacgacttgtgggtaaagatgtgcaatctctgtagagtgtaaaactgatatatgagccgtgcgtactgtcaagagcggttcgggcctctcgcatagttaaattataaaattgaattaaaacagacatgcattttattgttggtattgtctctatgatcatttatttaactaatactttatgtacttacatttagtaattgctaataaaattttgaccaacaaaatttaaaagtaatgattagcttcacctacattacttggtaagccttacattgcacttttttctacaaattttgctgagtacacaccataaatgtacttacccttgcggaatttgttgctcagaactatagatggccagccgggccgggctaaacgggccggcccgaagcacggcacggcccgtagtgcctgggcacggcacgacacggctagtgtcgggcccgtgccggcacggcccgataggtagtgccgtgcctgggccgagcatcaggcacgctgggccggcacgggcacggcacgattagcccctaggcacggttaggcacgattatacatgattagatccaagcacgagtagttagctgtgtgttgtactcttttttcttatatagggttttctcacaagggtgagtttttatctaaataggtttttaatgagtcagccattgcactaaacagttcaatattagctattttagtatgttttaactgtgtttgtgaatatctgactaaaattctgtggtatagtgctaaacgggctaaacgggctaaacgggccggcacggcacggctaagcaggcttagtgccgtgcttgggcctggccttaggcactagtgccgtgccggcacggcacggctattaaacgggctaaacgggtcgtgccctaaccgtgtcgtgcctggccgtgcccgggccgggccgtgccgtgccgcccatttggccatctctactcataaccaagtcaccaagtcaccaagaggaagactactatgatgagttcgagcctgtcgtcgccacatcttgtgatcgggttcgtcgtcactgtaatcgttgtttagtttccattatttagttaatttttgtaaagacattatgcttatataatagagtttgtgacactagtttgtacactgagtaatcatatgtgtaaaacttctgacacacatatgaaatatatttaggtttatctttaaatctggtgtgatagttttcatgagagaaatcttggtgtagagtgcagtactaaaaaaattacaatcgtgtcaaaaccgtagtattcaaacactatatcataaagttcacccaaacacccaaacactatatcataaaatgcctttacaaccgaccctaaaccgcggaggcattccatattgtccatagagataaagcggccaatccgggtcgtgggtcgtggccaagggtgtggaggtggtgccatggttgcgccggaaagacctggtgggtccgcgcctgacgacttgctgaagaatcgtttcctccacacctatatattgggccctgcgctacacaggcactggcggcctccagcaccagtgtggcaacacaacagtatacagagcgcagggcgaaccacgtgacagaggaagtcgtgcagacggcgaggcagcccaacggttgttcggccggccatttcgcaatctctcctcgccgctcatccctgagcgcacgcaaaagaaaggttgcccatcgttgcgcaccggttctctgtgcgacgtttgtttgtctcttttaggatcctttggggttttctcttctttcgaacgcgttgagttcttctctgtgcgacgcggtctgggtttgggatctagtgcggtgacttctcgtcttccttgtctggcgacgattagaaaaggactcgccctcgccatcgccatcgccatcgcccggttgttgcttggctctttctctttgtctcgcacggtcatttcttcttgacacacttcggtttcttttttttttcttttgcttcctagtttggacacaaggtttatttgaaaaagcgggattgttgatccctacctatgtgttccatttcatatgtatatattttctaatatttttgtaaaacgactgttgtgcgaaaagattggggttttgtggcctaccacatagtcgtgggcctcgtggggttttagatgacgaactccgcgttggttttctgagtcgtggggttttcgatgacgaatggtgttctatataaataaagtttaatcatttatggaatttatcatgcgagctagccttcctcttccgcgtttcttcttggagatattaacgtcaaatggtgcaatgcgattttttcccccattgccatttgccccgcctacgccttccatctttatttccatctcccgtaactccgttcccttcctttcttttcacgccactgtggttttactagtagctgatcatggcgctcgttcctttcctagggacgtgagtagctgcataaaccatggcctcttcatctgcacccaggttccgtgtctattccaagtacctctttctaacatatcctcaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgcaaacacagctgagtggggaacattcgtggcagtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactccgtaagcctcgaatcctatatcatttgtacttccactcctgcggatcaagcgcaatctgacttagagtggatggacgattattccaggagtcaccggggaggcataagtccatctacatctgcgggccaaccagaacaggaaagacttcctgggcaaggtctctagggacacacaattattataacagtctagttgatttcacaacatatgacgtcaacgccaagtataatatcatcgacgacattccattcaagttcacaccgaactggaagtgcttcgtcggggctcagcgtgacttcacggtcaatccaaaatatggtaagcgaaaagtcatacggggtggaataccttgcatcattttagttaatccagacgaagattggctcaaggatatgactcccgaacagtcggattacatgtactctaacgctgttgttcactacatgtatgaaggcgagtctttcatcaactactcgttcgcctccggcgaagatgtcactgcttcgcagtgagctcaagctactccttgaccacgggaaaccctttcctgaacaaggctttgctcttctgaagactgaacaaggctgctgcattatttattatgaacaagcctgaacaaggctgcattatactagcttaacgtttgtagtttgcattttatttcatataaacgatccaagtctttgccgaacttgattattatattcagttattcagcattcacgggacgctagagggaaaaatcgaaattttgaaacgctttggtgaaccattttatattcagttaagcattccaattaaggcattgttcggttattttaatttcatgcgtattggtgtatatttggatggaatttgacttattatggatttaaactgattcaataccacccaatccacatggattaacgatgaaacgaaccagccctaaggtttccctgtaactagttgcatgaattttattcatcaactgttttttcgacggctagagagaaaatcaaaataaagatggatacatgtaagatcgaaactactaggaattgatggcgcagtaaactgtcatgtcctgtacagtttgcttatggttcaccaaagcgtttagaatctatccttgaaaaaaacgatatcgatatctttggaaatattggcgttcggctttagactaattctacttcggtgttgctgcaatgtagataattgatgacatgattgattcgttttatctattattttatatatattaaaaactatagactgttttagctttgccctaaattaaatttgtaactttgggcaatttttaaatagcagaatctagaatatattttatcttatttttctcattttttttaaaaaaacatgtatcttgataatgtatttatttgaacacgttgataacattttgtatctgaatccatgagtcagtaatttttgaacagacacggagaagctctcatccattctggtggcagaggaccggaaccaacatcattttttaaaaaaaactacagtggaaagaagaatatccattatgtttttgggaagttactgtagcccagggttctttggaactcctgtagtatttttataaataaacttctcgtaaagcctttttttaaaaaaaatggatctaaaacttgagtcatagaccaatgtgccgagaattggtgtcaggccacattcagctcttgcacagggtcgttcctgatttttgagggacccgggacaagattataaacgtaggccccagcaccataaaaactattttttactattatatatactccctccgtttcgttttaggcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatct

SEQ ID NO: 187 - DNA, 29472 bp, Zea mays derived;
tcacctagatccttttgatccggaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttaagccaatttacggcgatcgcgagatgggctaccgcgcacttccttataagctaaggcatggcacagatttccaagtcaaaagtgtgataaatcaacatcttccacgaaagtgatcagaaaagatgtggtccaaaagcctccgcgcactcacgaaaagccgagtgcgcgtcgggggccaccacgcggggtaatattataacccgcgtggaggccccccgaccacacaccgaacagggcccacacgatacgctacgctcccgtgggaacacaagggccctgttctcccgccaaaacctgccctatataaagcattggacacattgcatttgcagtgtgcagaattcacacctccacgcagggtagagcatagagttttctggcacaccccgttttttcgctaaggacctgccggacttctgttcactaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctgctctagatccccgaatttccccgaccgttcaaacatttggcaataactgtcctagcgcggacggcgtacagtttctataaatgtaatatctcagggtgttgtatttcgttttccgatgtcattgtgtaagggttgttttttgttataatttggtttgtctttgctcgtagccgagcctctgtaatcgaatgacatgagataaataaaatattattttacggacccaagtatgtgtgcgctctgtcggaagctacataggattaccataacagatagctgacggcctacaaaaaaagatagaatacaggagaacatcacacagataaaaacatatcacccttgtactagcagggaggcggtgcttgctggattttagatcagttgcttgctggattttagatcagtacacagtcctgccatcaccatccaggatcatatccttgaaagccccaccactagggatcataggcaacacatgctcctggtgtgggacgattatatccaagaggtacggccctggagtctcgagcatcttctttatcgctgcgcggacttcgttcttctttgtcacacggaccgctggaatgttgaaccctttggcgatcgtcacgaaatctggatatatctcactttcattctctgggtttcccaagtaggtgtgagccctattcgccttatagaacctgtcctccaactgcaccaccatccccaggtgctggttgtttagcacaaagaccttcaccgggaggttctcaattcggatcatagctagctcctgaacgttcatgagaaagctaccatctccatcgatgtcaacaacagtaacacctgggttggccacagaagcaccagcagcagccggcaaaccaaatcccatagccccaagaccagctgaagacaaccactgccttggccgcttgtaagtgtagtactgtgccgcccacatctggtgctgcccaacacctgtgccgatgatggcctcgcctttcgtcagctcatcaagaacctgaatagcatattgtggctggatctcctcattagatgttttatacccaagggggaattccctcttctgctgatccaacagagcgcacacatacttgcggacccgagatgggctaccgcgcacttccttataagctaaggcatggcacagatttccaagtcaaaagtgtgataaatcaacatcttccacgaaagtgatcagaaaagatgtggtccaaaagcctccgcgcactcacgaaaagccgagtgcgcgtcgggggccaccacgcggggtaatattataacccgcgtggaggccccccgaccacacaccgaacagggcccacacgatacgctacgctcccgtgggaacacaagggccctgttctcccgccaaaacctgccctatataaagcattggacacattgcatttgcagtgtgcagaattcacacctccacgcagggtagagcatagagttttctggcacaccccgttttttcgctaaggacctgccggacttctgttcactaccgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacaagtatgtgtgcgctctgtgttttagagctagaaatagcaagttaaaataaggctagtccgttatcaacttgaaaaagtggcaccgagtcggtgctttttttttcggaccggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgactatctatgttaaaatattagatttttcatataagtcagatgttttaggaccatctctatcgttgtgtgatattgatacttatgaatcatgataatattttattatggttttttattgttgggttatttattatacattataagatcaccttatttaaccagaacaaggaataacaacttgagaaaacagtacaaccaaaaggactattatgactactgttctggctaattaattagagaagttagtgtgtgagaaccttacccaaaagggacaagtggagagtagttactcaagtatagagaggttctcgggctgatctgctctatggtagcttttcagacgagatattcctataccacctctgcttgaaatcgtagcgggttttctcatgctactgcaactttgtaaaggtctcgtagtgaatcctgtcctacctcctataaagaggtgaatgatctagctaacctgaggcaaatgagaaatacgacttgtgggtaaagatgtgcaatctctgtagagtgtaaaactgatatatgagccgtgcgtactgtcaagagcggttcgggcctctcgcatagttaaattataaaattgaattaaaacagacatgcattttattgttggtattgtctctatgatcatttatttaactaatactttatgtacttacatttagtaattgctaataaaattttgaccaacaaaatttaaaagtaatgattagcttcacctacattacttggtaagccttacattgcacttttttctacaaattttgctgagtacacaccataaatgtacttacccttgcggaatttgttgctcagaactatagatggccagccgggccgggctaaacgggccggcccgaagcacggcacggcccgtagtgcctgggcacggcacgacacggctagtgtcgggcccgtgccggcacggcccgataggtagtgccgtgcctgggccgagcatcaggcacgctgggccggcacgggcacggcacgattagcccctaggcacggttaggcacgattatacatgattagatccaagcacgagtagttagctgtgtgttgtactcttttttcttatatagggttttctcacaagggtgagtttttatctaaataggtttttaatgagtcagccattgcactaaacagttcaatattagctattttagtatgttttaactgtgtttgtgaatatctgactaaaattctgtggtatagtgctaaacgggctaaacgggctaaacgggccggcacggcacggctaagcaggcttagtgccgtgcttgggcctggccttaggcactagtgccgtgccggcacggcacggctattaaacgggctaaacgggtcgtgccctaaccgtgtcgtgcctggccgtgcccgggccgggccgtgccgtgccgcccatttggccatctctactcataaccaagtcaccaagtcaccaagaggaagactactatgatgagttcgagcctgtcgtcgccacatcttgtgatcgggttcgtcgtcactgtaatcgttgtttagtttccattatttagttaatttttgtaaagacattatgcttatataatagagtttgtgacactagtttgtacactgagtaatcatatgtgtaaaacttctgacacacatatgaaatatatttaggtttatctttaaatctggtgtgatagttttcatgagagaaatcttggtgtagagtgcagtactaaaaaaattacaatcgtgtcaaaaccgtagtattcaaacactatatcataaagttcacccaaacacccaaacactatatcataaaatgcctttacaaccgaccctaaaccgcggaggcattccatattgtccatagagataaagcggccaatccgggtcgtgggtcgtggccaagggtgtggaggtggtgccatggttgcgccggaaagacctggtgggtccgcgcctgacgacttgctgaagaatcgtttcctccacacctatatattgggccctgcgctacacaggcactggcggcctccagcaccagtgtggcaacacaacagtatacagagcgcagggcgaaccacgtgacagaggaagtcgtgcagacggcgaggcagcccaacggttgttcggccggccatttcgcaatctctcctcgccgctcatccctgagcgcacgcaaaagaaaggttgcccatcgttgcgcaccggttctctgtgcgacgtttgtttgtctcttttaggatcctttggggttttctcttctttcgaacgcgttgagttcttctctgtgcgacgcggtctgggtttgggatctagtgcggtgacttctcgtcttccttgtctggcgacgattagaaaaggactcgccctcgccatcgccatcgccatcgcccggttgttgcttggctctttctctttgtctcgcacggtcatttcttcttgacacacttcggtttcttttttttttcttttgcttcctagtttggacacaaggtttatttgaaaaagcgggattgttgatccctacctatgtgttccatttcatatgtatatattttctaatatttttgtaaaacgactgttgtgcgaaaagattggggttttgtggcctaccacatagtcgtgggcctcgtggggttttagatgacgaactccgcgttggttttctgagtcgtggggttttcgatgacgaatggtgttctatataaataaagtttaatcatttatggaatttatcatgcgagctagccttcctcttccgcgtttcttcttggagatattaacgtcaaatggtgcaatgcgattttttcccccattgccatttgccccgcctacgccttccatctttatttccatctcccgtaactccgttcccttcctttcttttcacgccactgtggttttactagtagctgatcatggcgctcgttcctttcctagggacgtgagtagctgcataaaccatggcctcttcatctgcacccaggttccgtgtctattccaagtacctctttctaacatatcctcaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgcaaacacagctgagtggggaacattcgtggcagtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactccgtaagcctcgaatcctatatcatttgtacttccactcctgcggatcaagcgcaatctgacttagagtggatggacgattattccaggagtcaccggggaggcataagtccatctacatctgcgggccaaccagaacaggaaagacttcctgggcaaggtctctagggacacacaattattataacagtctagttgatttcacaacatatgacgtcaacgccaagtataatatcatcgacgacattccattcaagttcacaccgaactggaagtgcttcgtcggggctcagcgtgacttcacggtcaatccaaaatatggtaagcgaaaagtcatacggggtggaataccttgcatcattttagttaatccagacgaagattggctcaaggatatgactcccgaacagtcggattacatgtactctaacgctgttgttcactacatgtatgaaggcgagtctttcatcaactactcgttcgcctccggcgaagatgtcactgcttcgcagtgagctcaagctactccttgaccacgggaaaccctttcctgaacaaggctttgctcttctgaagactgaacaaggctgctgcattatttattatgaacaagcctgaacaaggctgcattatactagcttaacgtttgtagtttgcattttatttcatataaacgatccaagtctttgccgaacttgattattatattcagttattcagcattcacgggacgctagagggaaaaatcgaaattttgaaacgctttggtgaaccattttatattcagttaagcattccaattaaggcattgttcggttattttaatttcatgcgtattggtgtatatttggatggaatttgacttattatggatttaaactgattcaataccacccaatccacatggattaacgatgaaacgaaccagccctaaggtttccctgtaactagttgcatgaattttattcatcaactgttttttcgacggctagagagaaaatcaaaataaagatggatacatgtaagatcgaaactactaggaattgatggcgcagtaaactgtcatgtcctgtacagtttgcttatggttcaccaaagcgtttagaatctatccttgaaaaaaacgatatcgatatctttggaaatattggcgttcggctttagactaattctacttcggtgttgctgcaatgtagataattgatgacatgattgattcgttttatctattattttatatatattaaaaactatagactgttttagctttgccctaaattaaatttgtaactttgggcaatttttaaatagcagaatctagaatatattttatcttatttttctcattttttttaaaaaaacatgtatcttgataatgtatttatttgaacacgttgataacattttgtatctgaatccatgagtcagtaatttttgaacagacacggagaagctctcatccattctggtggcagaggaccggaaccaacatcattttttaaaaaaaactacagtggaaagaagaatatccattatgtttttgggaagttactgtagcccagggttctttggaactcctgtagtatttttataaataaacttctcgtaaagcctttttttaaaaaaaatggatctaaaacttgagtcatagaccaatgtgccgagaattggtgtcaggccacattcagctcttgcacagggtcgttcctgatttttgagggacccgggacaagattataaacgtaggccccagcaccataaaaactattttttactattatatatactccctccgtttcgttttaggcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatct

SEQ ID NO: 188 - DNA, 29452 bp, Zea mays derived;
tcacctagatccttttgatccggaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttaagccaatttacggcgatcgcgagatgggctaccgcgcacttccttataagctaaggcatggcacagatttccaagtcaaaagtgtgataaatcaacatcttccacgaaagtgatcagaaaagatgtggtccaaaagcctccgcgcactcacgaaaagccgagtgcgcgtcgggggccaccacgcggggtaatattataacccgcgtggaggccccccgaccacacaccgaacagggcccacacgatacgctacgctcccgtgggaacacaagggccctgttctcccgccaaaacctgccctatataaagcattggacacattgcatttgcagtgtgcagaattcacacctccacgcagggtagagcatagagttttctggcacaccccgttttttcgctaaggacctgccggacttctgttcactaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctgctctagatccccgaatttccccgaccgttcaaacatttggcaataactgtcctagcgcggacggcgtacagtttctataaatgtaatatctcagggtgttgtatttcgttttccgatgtcattgtgtaagggttgttttttgttataatttggtttgtctttgctcgtagccgagcctctgtaatcgaatgacatgagataaataaaatattattttacggacccaagtatgtgtgcgctctgtcggaagctacataggattaccataacagatagctgacggcctacaaaaaaagatagaatacaggagaacatcacacagataaaaacatatcacccttgtactagcagggaggcggtgcttgctggattttagatcagttgcttgctggattttagatcagtacacagtcctgccatcaccatccaggatcatatccttgaaagccccaccactagggatcataggcaacacatgctcctggtgtgggacgattatatccaagaggtacggccctggagtctcgagcatcttctttatcgctgcgcggacttcgttcttctttgtcacacggaccgctggaatgttgaaccctttggcgatcgtcacgaaatctggatatatctcactttcattctctgggtttcccaagtaggtgtgagccctattcgccttatagaacctgtcctccaactgcaccaccatccccaggtgctggttgtttagcacaaagaccttcaccgggaggttctcaattcggatcatagctagctcctgaacgttcatgagaaagctaccatctccatcgatgtcaacaacagtaacacctgggttggccacagaagcaccagcagcagccggcaaaccaaatcccatagccccaagaccagctgaagacaaccactgccttggccgcttgtaagtgtagtactgtgccgcccacatctggtgctgcccaacacctgtgccgatgatggcctcgcctttcgtcagctcatcaagaacctgaatagcatattgtggctggatctcctcattagatgttttatacccaagggggaattccctcttctgctgatccacggacccgagatgggctaccgcgcacttccttataagctaaggcatggcacagatttccaagtcaaaagtgtgataaatcaacatcttccacgaaagtgatcagaaaagatgtggtccaaaagcctccgcgcactcacgaaaagccgagtgcgcgtcgggggccaccacgcggggtaatattataacccgcgtggaggccccccgaccacacaccgaacagggcccacacgatacgctacgctcccgtgggaacacaagggccctgttctcccgccaaaacctgccctatataaagcattggacacattgcatttgcagtgtgcagaattcacacctccacgcagggtagagcatagagttttctggcacaccccgttttttcgctaaggacctgccggacttctgttcactaccgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacaagtatgtgtgcgctctgtgttttagagctagaaatagcaagttaaaataaggctagtccgttatcaacttgaaaaagtggcaccgagtcggtgctttttttttcggaccggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgactatctatgttaaaatattagatttttcatataagtcagatgttttaggaccatctctatcgttgtgtgatattgatacttatgaatcatgataatattttattatggttttttattgttgggttatttattatacattataagatcaccttatttaaccagaacaaggaataacaacttgagaaaacagtacaaccaaaaggactattatgactactgttctggctaattaattagagaagttagtgtgtgagaaccttacccaaaagggacaagtggagagtagttactcaagtatagagaggttctcgggctgatctgctctatggtagcttttcagacgagatattcctataccacctctgcttgaaatcgtagcgggttttctcatgctactgcaactttgtaaaggtctcgtagtgaatcctgtcctacctcctataaagaggtgaatgatctagctaacctgaggcaaatgagaaatacgacttgtgggtaaagatgtgcaatctctgtagagtgtaaaactgatatatgagccgtgcgtactgtcaagagcggttcgggcctctcgcatagttaaattataaaattgaattaaaacagacatgcattttattgttggtattgtctctatgatcatttatttaactaatactttatgtacttacatttagtaattgctaataaaattttgaccaacaaaatttaaaagtaatgattagcttcacctacattacttggtaagccttacattgcacttttttctacaaattttgctgagtacacaccataaatgtacttacccttgcggaatttgttgctcagaactatagatggccagccgggccgggctaaacgggccggcccgaagcacggcacggcccgtagtgcctgggcacggcacgacacggctagtgtcgggcccgtgccggcacggcccgataggtagtgccgtgcctgggccgagcatcaggcacgctgggccggcacgggcacggcacgattagcccctaggcacggttaggcacgattatacatgattagatccaagcacgagtagttagctgtgtgttgtactcttttttcttatatagggttttctcacaagggtgagtttttatctaaataggtttttaatgagtcagccattgcactaaacagttcaatattagctattttagtatgttttaactgtgtttgtgaatatctgactaaaattctgtggtatagtgctaaacgggctaaacgggctaaacgggccggcacggcacggctaagcaggcttagtgccgtgcttgggcctggccttaggcactagtgccgtgccggcacggcacggctattaaacgggctaaacgggtcgtgccctaaccgtgtcgtgcctggccgtgcccgggccgggccgtgccgtgccgcccatttggccatctctactcataaccaagtcaccaagtcaccaagaggaagactactatgatgagttcgagcctgtcgtcgccacatcttgtgatcgggttcgtcgtcactgtaatcgttgtttagtttccattatttagttaatttttgtaaagacattatgcttatataatagagtttgtgacactagtttgtacactgagtaatcatatgtgtaaaacttctgacacacatatgaaatatatttaggtttatctttaaatctggtgtgatagttttcatgagagaaatcttggtgtagagtgcagtactaaaaaaattacaatcgtgtcaaaaccgtagtattcaaacactatatcataaagttcacccaaacacccaaacactatatcataaaatgcctttacaaccgaccctaaaccgcggaggcattccatattgtccatagagataaagcggccaatccgggtcgtgggtcgtggccaagggtgtggaggtggtgccatggttgcgccggaaagacctggtgggtccgcgcctgacgacttgctgaagaatcgtttcctccacacctatatattgggccctgcgctacacaggcactggcggcctccagcaccagtgtggcaacacaacagtatacagagcgcagggcgaaccacgtgacagaggaagtcgtgcagacggcgaggcagcccaacggttgttcggccggccatttcgcaatctctcctcgccgctcatccctgagcgcacgcaaaagaaaggttgcccatcgttgcgcaccggttctctgtgcgacgtttgtttgtctcttttaggatcctttggggttttctcttctttcgaacgcgttgagttcttctctgtgcgacgcggtctgggtttgggatctagtgcggtgacttctcgtcttccttgtctggcgacgattagaaaaggactcgccctcgccatcgccatcgccatcgcccggttgttgcttggctctttctctttgtctcgcacggtcatttcttcttgacacacttcggtttcttttttttttcttttgcttcctagtttggacacaaggtttatttgaaaaagcgggattgttgatccctacctatgtgttccatttcatatgtatatattttctaatatttttgtaaaacgactgttgtgcgaaaagattggggttttgtggcctaccacatagtcgtgggcctcgtggggttttagatgacgaactccgcgttggttttctgagtcgtggggttttcgatgacgaatggtgttctatataaataaagtttaatcatttatggaatttatcatgcgagctagccttcctcttccgcgtttcttcttggagatattaacgtcaaatggtgcaatgcgattttttcccccattgccatttgccccgcctacgccttccatctttatttccatctcccgtaactccgttcccttcctttcttttcacgccactgtggttttactagtagctgatcatggcgctcgttcctttcctagggacgtgagtagctgcataaaccatggcctcttcatctgcacccaggttccgtgtctattccaagtacctctttctaacatatcctcaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgcaaacacagctgagtggggaacattcgtggcagtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactccgtaagcctcgaatcctatatcatttgtacttccactcctgcggatcaagcgcaatctgacttagagtggatggacgattattccaggagtcaccggggaggcataagtccatctacatctgcgggccaaccagaacaggaaagacttcctgggcaaggtctctagggacacacaattattataacagtctagttgatttcacaacatatgacgtcaacgccaagtataatatcatcgacgacattccattcaagttcacaccgaactggaagtgcttcgtcggggctcagcgtgacttcacggtcaatccaaaatatggtaagcgaaaagtcatacggggtggaataccttgcatcattttagttaatccagacgaagattggctcaaggatatgactcccgaacagtcggattacatgtactctaacgctgttgttcactacatgtatgaaggcgagtctttcatcaactactcgttcgcctccggcgaagatgtcactgcttcgcagtgagctcaagctactccttgaccacgggaaaccctttcctgaacaaggctttgctcttctgaagactgaacaaggctgctgcattatttattatgaacaagcctgaacaaggctgcattatactagcttaacgtttgtagtttgcattttatttcatataaacgatccaagtctttgccgaacttgattattatattcagttattcagcattcacgggacgctagagggaaaaatcgaaattttgaaacgctttggtgaaccattttatattcagttaagcattccaattaaggcattgttcggttattttaatttcatgcgtattggtgtatatttggatggaatttgacttattatggatttaaactgattcaataccacccaatccacatggattaacgatgaaacgaaccagccctaaggtttccctgtaactagttgcatgaattttattcatcaactgttttttcgacggctagagagaaaatcaaaataaagatggatacatgtaagatcgaaactactaggaattgatggcgcagtaaactgtcatgtcctgtacagtttgcttatggttcaccaaagcgtttagaatctatccttgaaaaaaacgatatcgatatctttggaaatattggcgttcggctttagactaattctacttcggtgttgctgcaatgtagataattgatgacatgattgattcgttttatctattattttatatatattaaaaactatagactgttttagctttgccctaaattaaatttgtaactttgggcaatttttaaatagcagaatctagaatatattttatcttatttttctcattttttttaaaaaaacatgtatcttgataatgtatttatttgaacacgttgataacattttgtatctgaatccatgagtcagtaatttttgaacagacacggagaagctctcatccattctggtggcagaggaccggaaccaacatcattttttaaaaaaaactacagtggaaagaagaatatccattatgtttttgggaagttactgtagcccagggttctttggaactcctgtagtatttttataaataaacttctcgtaaagcctttttttaaaaaaaatggatctaaaacttgagtcatagaccaatgtgccgagaattggtgtcaggccacattcagctcttgcacagggtcgttcctgatttttgagggacccgggacaagattataaacgtaggccccagcaccataaaaactattttttactattatatatactccctccgtttcgttttaggcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatct

SEQ ID NO: 189 - DNA, 174 bp, Zea mays derived;; identical to SEQ ID NO: 107

SEQ ID NO: 190 - DNA, 168 bp, Zea mays derived;
tgggaggccggcaagccatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 191 - DNA, 173 bp, Zea mays derived;
tgggaggccggcaagccactgtctcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 192 - DNA, 173 bp, Zea mays derived;; identical to SEQ ID NO: 191

SEQ ID NO: 193 - DNA, 169 bp, Zea mays derived;
tgggaggccggcaagccactcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 194 - DNA, 173 bp, Zea mays derived;; identical to SEQ ID NO: 191

SEQ ID NO: 195 - DNA, 160 bp, Zea mays derived;
tgggaggccggcaagccactggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 196 - DNA, 166 bp, Zea mays derived;
tgggaggccggcaagcccgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 197 - DNA, 146 bp, Zea mays derived;
tgggaggccggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 198 - DNA, 173 bp, Zea mays derived;
tgggaggccggcaagccactgtcgcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 199 - DNA, 174 bp, Zea mays derived;
tgggaggccggcaagccactgtcgtcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 200 - DNA, 175 bp, Zea mays derived;; identical to SEQ ID NO: 103
  misc_feature (26)..(26): n is a, c, g, or t

SEQ ID NO: 201 - DNA, 169 bp, Zea mays derived;; identical to SEQ ID NO: 193

SEQ ID NO: 202 - DNA, 173 bp, Zea mays derived;; identical to SEQ ID NO: 191

SEQ ID NO: 203 - DNA, 174 bp, Zea mays derived;; identical to SEQ ID NO: 199

SEQ ID NO: 204 - DNA, 174 bp, Zea mays derived;; identical to SEQ ID NO: 199

SEQ ID NO: 205 - DNA, 173 bp, Zea mays derived;; identical to SEQ ID NO: 191

SEQ ID NO: 206 - DNA, 174 bp, Zea mays derived;
tgggaggccggcaagccactgtcgacgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 207 - DNA, 174 bp, Zea mays derived;; identical to SEQ ID NO: 199

SEQ ID NO: 208 - DNA, 165 bp, Zea mays derived;
tgggaggccggcaagccactgtggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 209 - DNA, 175 bp, Zea mays derived;; identical to SEQ ID NO: 103
  misc_feature (26)..(26): n is a, c, g, or t

SEQ ID NO: 210 - DNA, 173 bp, Zea mays derived;; identical to SEQ ID NO: 191

SEQ ID NO: 211 - DNA, 174 bp, Zea mays derived;; identical to SEQ ID NO: 199

SEQ ID NO: 212 - DNA, 175 bp, Zea mays derived;; identical to SEQ ID NO: 103
  misc_feature (26)..(26): n is a, c, g, or t

SEQ ID NO: 213 - DNA, 174 bp, Zea mays derived;; identical to SEQ ID NO: 199

SEQ ID NO: 214 - DNA, 169 bp, Zea mays derived;; identical to SEQ ID NO: 193

SEQ ID NO: 215 - DNA, 174 bp, Zea mays derived;; identical to SEQ ID NO: 199

SEQ ID NO: 216 - DNA, 173 bp, Zea mays derived;; identical to SEQ ID NO: 191

SEQ ID NO: 217 - DNA, 175 bp, Zea mays derived;; identical to SEQ ID NO: 103
  misc_feature (26)..(26): n is a, c, g, or t

SEQ ID NO: 218 - DNA, 175 bp, Zea mays derived;; identical to SEQ ID NO: 103
  misc_feature (26)..(26): n is a, c, g, or t

SEQ ID NO: 219 - DNA, 174 bp, Zea mays derived;; identical to SEQ ID NO: 199

SEQ ID NO: 220 - DNA, 174 bp, Zea mays derived;; identical to SEQ ID NO: 199

SEQ ID NO: 221 - DNA, 175 bp, Zea mays derived;; identical to SEQ ID NO: 103
  misc_feature (26)..(26): n is a, c, g, or t

SEQ ID NO: 222 - DNA, 169 bp, Zea mays derived;; identical to SEQ ID NO: 193

SEQ ID NO: 223 - DNA, 175 bp, Zea mays derived;; identical to SEQ ID NO: 103
  misc_feature (26)..(26): n is a, c, g, or t

SEQ ID NO: 224 - DNA, 175 bp, Zea mays derived;; identical to SEQ ID NO: 103
  misc_feature (26)..(26): n is a, c, g, or t

SEQ ID NO: 225 - DNA, 171 bp, Zea mays derived;
tgggaggccggcaagccactgtcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 226 - DNA, 175 bp, Zea mays derived;; identical to SEQ ID NO: 103
  misc_feature (26)..(26): n is a, c, g, or t

SEQ ID NO: 227 - DNA, 172 bp, Zea mays derived;
tgggaggccggcaagccactgttcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 228 - DNA, 175 bp, Zea mays derived;; identical to SEQ ID NO: 103
  misc_feature (26)..(26): n is a, c, g, or t

SEQ ID NO: 229 - DNA, 175 bp, Zea mays derived;; identical to SEQ ID NO: 103
  misc_feature (26)..(26): n is a, c, g, or t

SEQ ID NO: 230 - DNA, 171 bp, Zea mays derived;; identical to SEQ ID NO: 225

SEQ ID NO: 231 - DNA, 175 bp, Zea mays derived;; identical to SEQ ID NO: 103
  misc_feature (26)..(26): n is a, c, g, or t

SEQ ID NO: 232 - DNA, 169 bp, Zea mays derived;
tgggaggccggcaagccactggaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 233 - DNA, 175 bp, Zea mays derived;; identical to SEQ ID NO: 103
  misc_feature (26)..(26): n is a, c, g, or t

SEQ ID NO: 234 - DNA, 175 bp, Zea mays derived;
  misc_feature (26)..(28): n is a, c, g, or t
tgggaggccggcaagccactgtcgannntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatga

SEQ ID NO: 235 - DNA, 175 bp, Zea mays derived;
  misc_feature (26)..(27): n is a, c, g, or t
tgggaggccggcaagccactgtcganntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgat

SEQ ID NO: 236 - DNA, 175 bp, Zea mays derived;; identical to SEQ ID NO: 103
  misc_feature (26)..(26): n is a, c, g, or t

SEQ ID NO: 237 - DNA, 175 bp, Zea mays derived;; identical to SEQ ID NO: 103
  misc_feature (26)..(26): n is a, c, g, or t

SEQ ID NO: 238 - DNA, 171 bp, Zea mays derived;; identical to SEQ ID NO: 225

SEQ ID NO: 239 - DNA, 175 bp, Zea mays derived;; identical to SEQ ID NO: 103
  misc_feature (26)..(26): n is a, c, g, or t

SEQ ID NO: 240 - DNA, 175 bp, Zea mays derived;; identical to SEQ ID NO: 103
  misc_feature (26)..(26): n is a, c, g, or t

SEQ ID NO: 241 - DNA, 171 bp, Zea mays derived;; identical to SEQ ID NO: 225

SEQ ID NO: 242 - DNA, 175 bp, Zea mays derived;; identical to SEQ ID NO: 103
  misc_feature (26)..(26): n is a, c, g, or t

SEQ ID NO: 243 - DNA, 171 bp, Zea mays derived;; identical to SEQ ID NO: 225

SEQ ID NO: 244 - DNA, 175 bp, Zea mays derived;; identical to SEQ ID NO: 103
  misc_feature (26)..(26): n is a, c, g, or t

SEQ ID NO: 245 - DNA, 171 bp, Zea mays derived;; identical to SEQ ID NO: 225

SEQ ID NO: 246 - DNA, 175 bp, Zea mays derived;; identical to SEQ ID NO: 103
  misc_feature (26)..(26): n is a, c, g, or t

SEQ ID NO: 247 - DNA, 171 bp, Zea mays derived;; identical to SEQ ID NO: 225

SEQ ID NO: 248 - DNA, 175 bp, Zea mays derived;; identical to SEQ ID NO: 103
  misc_feature (26)..(26): n is a, c, g, or t

SEQ ID NO: 249 - DNA, 171 bp, Zea mays derived;; identical to SEQ ID NO: 225

SEQ ID NO: 250 - DNA, 175 bp, Zea mays derived;; identical to SEQ ID NO: 103
  misc_feature (26)..(26): n is a, c, g, or t

SEQ ID NO: 251 - DNA, 171 bp, Zea mays derived;; identical to SEQ ID NO: 225

SEQ ID NO: 252 - DNA, 175 bp, Zea mays derived;; identical to SEQ ID NO: 103
  misc_feature (26)..(26): n is a, c, g, or t

SEQ ID NO: 253 - DNA, 171 bp, Zea mays derived;; identical to SEQ ID NO: 225

SEQ ID NO: 254 - DNA, 175 bp, Zea mays derived;; identical to SEQ ID NO: 103
  misc_feature (26)..(26): n is a, c, g, or t

SEQ ID NO: 255 - DNA, 171 bp, Zea mays derived;; identical to SEQ ID NO: 225

SEQ ID NO: 256 - DNA, 175 bp, Zea mays derived;; identical to SEQ ID NO: 103
  misc_feature (26)..(26): n is a, c, g, or t

SEQ ID NO: 257 - DNA, 171 bp, Zea mays derived;; identical to SEQ ID NO: 225

SEQ ID NO: 258 - DNA, 175 bp, Zea mays derived;; identical to SEQ ID NO: 103
  misc_feature (26)..(26): n is a, c, g, or t

SEQ ID NO: 259 - DNA, 171 bp, Zea mays derived;; identical to SEQ ID NO: 225

SEQ ID NO: 260 - DNA, 159 bp, Zea mays derived;
tgggaggccgcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 261 - DNA, 171 bp, Zea mays derived;; identical to SEQ ID NO: 225

SEQ ID NO: 262 - DNA, 173 bp, Zea mays derived;; identical to SEQ ID NO: 191

SEQ ID NO: 263 - DNA, 169 bp, Zea mays derived;
tgggaggccggcaagccactgtcggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 264 - DNA, 171 bp, Zea mays derived;; identical to SEQ ID NO: 225

SEQ ID NO: 265 - DNA, 168 bp, Zea mays derived;
tgggaggccggcaagccactgtggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 266 - DNA, 171 bp, Zea mays derived;; identical to SEQ ID NO: 225

SEQ ID NO: 267 - DNA, 159 bp, Zea mays derived;
tgggaggccggcaagccactgtggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 268 - DNA, 173 bp, Zea mays derived;; identical to SEQ ID NO: 191

SEQ ID NO: 269 - DNA, 173 bp, Zea mays derived;
tgggaggccggcaagccactgtcgagaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 270 - DNA, 159 bp, Zea mays derived;; identical to SEQ ID NO: 260

SEQ ID NO: 271 - DNA, 172 bp, Zea mays derived;; identical to SEQ ID NO: 227

SEQ ID NO: 272 - DNA, 171 bp, Zea mays derived;; identical to SEQ ID NO: 225

SEQ ID NO: 273 - DNA, 169 bp, Zea mays derived;; identical to SEQ ID NO: 263

SEQ ID NO: 274 - DNA, 171 bp, Zea mays derived;; identical to SEQ ID NO: 225

SEQ ID NO: 275 - DNA, 170 bp, Zea mays derived;
tgggaggccggcaagccactgtgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 276 - DNA, 171 bp, Zea mays derived;; identical to SEQ ID NO: 225

SEQ ID NO: 277 - DNA, 157 bp, Zea mays derived;
tgggaggccgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 278 - DNA, 174 bp, Zea mays derived;; identical to SEQ ID NO: 206

SEQ ID NO: 279 - DNA, 168 bp, Zea mays derived;
tgggaggccggcaagccactgtcgaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 280 - DNA, 168 bp, Zea mays derived;; identical to SEQ ID NO: 279

SEQ ID NO: 281 - DNA, 171 bp, Zea mays derived;; identical to SEQ ID NO: 225

SEQ ID NO: 282 - DNA, 168 bp, Zea mays derived;; identical to SEQ ID NO: 265

SEQ ID NO: 283 - DNA, 173 bp, Zea mays derived;; identical to SEQ ID NO: 191

SEQ ID NO: 284 - DNA, 175 bp, Zea mays derived;; identical to SEQ ID NO: 103
  misc_feature (26)..(26): n is a, c, g, or t

SEQ ID NO: 285 - DNA, 171 bp, Zea mays derived;; identical to SEQ ID NO: 225

SEQ ID NO: 286 - DNA, 175 bp, Zea mays derived;; identical to SEQ ID NO: 103
  misc_feature (26)..(26): n is a, c, g, or t

SEQ ID NO: 287 - DNA, 168 bp, Zea mays derived;; identical to SEQ ID NO: 279

SEQ ID NO: 288 - DNA, 175 bp, Zea mays derived;; identical to SEQ ID NO: 103
  misc_feature (26)..(26): n is a, c, g, or t

SEQ ID NO: 289 - DNA, 168 bp, Zea mays derived;; identical to SEQ ID NO: 265

SEQ ID NO: 290 - DNA, 175 bp, Zea mays derived;; identical to SEQ ID NO: 103
  misc_feature (26)..(26): n is a, c, g, or t

SEQ ID NO: 291 - DNA, 171 bp, Zea mays derived;; identical to SEQ ID NO: 225

SEQ ID NO: 292 - DNA, 160 bp, Zea mays derived;
tgggaggccgtcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 293 - DNA, 175 bp, Zea mays derived;; identical to SEQ ID NO: 103
  misc_feature (26)..(26): n is a, c, g, or t

SEQ ID NO: 294 - DNA, 159 bp, Zea mays derived;; identical to SEQ ID NO: 260

SEQ ID NO: 295 - DNA, 175 bp, Zea mays derived;; identical to SEQ ID NO: 103
  misc_feature (26)..(26): n is a, c, g, or t

SEQ ID NO: 296 - DNA, 175 bp, Zea mays derived;; identical to SEQ ID NO: 103
  misc_feature (26)..(26): n is a, c, g, or t

SEQ ID NO: 297 - DNA, 172 bp, Zea mays derived;; identical to SEQ ID NO: 227

SEQ ID NO: 298 - DNA, 175 bp, Zea mays derived;; identical to SEQ ID NO: 103
  misc_feature (26)..(26): n is a, c, g, or t

SEQ ID NO: 299 - DNA, 175 bp, Zea mays derived;; identical to SEQ ID NO: 234
  misc_feature (26)..(28): n is a, c, g, or t

SEQ ID NO: 300 - DNA, 175 bp, Zea mays derived;; identical to SEQ ID NO: 103
  misc_feature (26)..(26): n is a, c, g, or t

SEQ ID NO: 301 - DNA, 174 bp, Zea mays derived;; identical to SEQ ID NO: 199

SEQ ID NO: 302 - DNA, 168 bp, Zea mays derived;; identical to SEQ ID NO: 265

SEQ ID NO: 303 - DNA, 175 bp, Zea mays derived;; identical to SEQ ID NO: 103
  misc_feature (26)..(26): n is a, c, g, or t

SEQ ID NO: 304 - DNA, 175 bp, Zea mays derived;; identical to SEQ ID NO: 103
  misc_feature (26)..(26): n is a, c, g, or t

SEQ ID NO: 305 - DNA, 172 bp, Zea mays derived;; identical to SEQ ID NO: 227

SEQ ID NO: 306 - DNA, 175 bp, Zea mays derived;; identical to SEQ ID NO: 103
  misc_feature (26)..(26): n is a, c, g, or t

SEQ ID NO: 307 - DNA, 171 bp, Zea mays derived;; identical to SEQ ID NO: 225

SEQ ID NO: 308 - DNA, 173 bp, Zea mays derived;; identical to SEQ ID NO: 191

SEQ ID NO: 309 - DNA, 175 bp, Zea mays derived;; identical to SEQ ID NO: 103
  misc_feature (26)..(26): n is a, c, g, or t

SEQ ID NO: 310 - DNA, 175 bp, Zea mays derived;; identical to SEQ ID NO: 103
  misc_feature (26)..(26): n is a, c, g, or t

SEQ ID NO: 311 - DNA, 171 bp, Zea mays derived;; identical to SEQ ID NO: 225

SEQ ID NO: 312 - DNA, 175 bp, Zea mays derived;; identical to SEQ ID NO: 103
  misc_feature (26)..(26): n is a, c, g, or t

SEQ ID NO: 313 - DNA, 168 bp, Zea mays derived;; identical to SEQ ID NO: 265

SEQ ID NO: 314 - DNA, 165 bp, Zea mays derived;; identical to SEQ ID NO: 208

SEQ ID NO: 315 - DNA, 159 bp, Zea mays derived;; identical to SEQ ID NO: 267

SEQ ID NO: 316 - DNA, 165 bp, Zea mays derived;
tgggaggccggcaagccactgtcgaggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 317 - DNA, 171 bp, Zea mays derived;; identical to SEQ ID NO: 225

SEQ ID NO: 318 - DNA, 166 bp, Zea mays derived;
tgggaggccggcaagctcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 319 - DNA, 161 bp, Zea mays derived;
tgggaggccggcaaaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 320 - DNA, 174 bp, Zea mays derived;; identical to SEQ ID NO: 199

SEQ ID NO: 321 - DNA, 173 bp, Zea mays derived;; identical to SEQ ID NO: 191

SEQ ID NO: 322 - DNA, 175 bp, Zea mays derived;
  misc_feature (26)..(30): n is a, c, g, or t
tgggaggccggcaagccactgtcgannnnntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatat

SEQ ID NO: 323 - DNA, 174 bp, Zea mays derived;; identical to SEQ ID NO: 199

SEQ ID NO: 324 - DNA, 172 bp, Zea mays derived;; identical to SEQ ID NO: 227

SEQ ID NO: 325 - DNA, 170 bp, Zea mays derived;
tgggaggccggcaagccactgtcaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 326 - DNA, 154 bp, Zea mays derived;
tgggaggccgaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 327 - DNA, 160 bp, Zea mays derived;
tgggaggccggcaagccagtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 328 - DNA, 173 bp, Zea mays derived;; identical to SEQ ID NO: 269

SEQ ID NO: 329 - DNA, 174 bp, Zea mays derived;; identical to SEQ ID NO: 199

SEQ ID NO: 330 - DNA, 166 bp, Zea mays derived;
tgggaggccggcaagccactgtcgatggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 331 - DNA, 175 bp, Zea mays derived;; identical to SEQ ID NO: 103
  misc_feature (26)..(26): n is a, c, g, or t

SEQ ID NO: 332 - DNA, 175 bp, Zea mays derived;; identical to SEQ ID NO: 103
  misc_feature (26)..(26): n is a, c, g, or t

SEQ ID NO: 333 - DNA, 166 bp, Zea mays derived;
tgggaggccggcaagccactgtcggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 334 - DNA, 175 bp, Zea mays derived;; identical to SEQ ID NO: 322
  misc_feature (26)..(30): n is a, c, g, or t

SEQ ID NO: 335 - DNA, 175 bp, Zea mays derived;; identical to SEQ ID NO: 103
  misc_feature (26)..(26): n is a, c, g, or t

SEQ ID NO: 336 - DNA, 175 bp, Zea mays derived;; identical to SEQ ID NO: 103
  misc_feature (26)..(26): n is a, c, g, or t

SEQ ID NO: 337 - DNA, 165 bp, Zea mays derived;; identical to SEQ ID NO: 208

SEQ ID NO: 338 - DNA, 175 bp, Zea mays derived;; identical to SEQ ID NO: 103
  misc_feature (26)..(26): n is a, c, g, or t

SEQ ID NO: 339 - DNA, 173 bp, Zea mays derived;; identical to SEQ ID NO: 191

SEQ ID NO: 340 - DNA, 175 bp, Zea mays derived;; identical to SEQ ID NO: 103
  misc_feature (26)..(26): n is a, c, g, or t

SEQ ID NO: 341 - DNA, 175 bp, Zea mays derived;
  misc_feature (26)..(33): n is a, c, g, or t
tgggaggccggcaagccactgtcgannnnnnnntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtaga

SEQ ID NO: 342 - DNA, 171 bp, Zea mays derived;; identical to SEQ ID NO: 225

SEQ ID NO: 343 - DNA, 165 bp, Zea mays derived;; identical to SEQ ID NO: 208

SEQ ID NO: 344 - DNA, 175 bp, Zea mays derived;; identical to SEQ ID NO: 322
  misc_feature (26)..(30): n is a, c, g, or t

SEQ ID NO: 345 - DNA, 174 bp, Zea mays derived;; identical to SEQ ID NO: 199

SEQ ID NO: 346 - DNA, 175 bp, Zea mays derived;; identical to SEQ ID NO: 103
  misc_feature (26)..(26): n is a, c, g, or t

SEQ ID NO: 347 - DNA, 175 bp, Zea mays derived;; identical to SEQ ID NO: 103
  misc_feature (26)..(26): n is a, c, g, or t

SEQ ID NO: 348 - DNA, 165 bp, Zea mays derived;; identical to SEQ ID NO: 208

SEQ ID NO: 349 - DNA, 175 bp, Zea mays derived;; identical to SEQ ID NO: 103
  misc_feature (26)..(26): n is a, c, g, or t

SEQ ID NO: 350 - DNA, 172 bp, Zea mays derived;; identical to SEQ ID NO: 227

SEQ ID NO: 351 - DNA, 151 bp, Zea mays derived;
tgggaggccgtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 352 - DNA, 171 bp, Zea mays derived;; identical to SEQ ID NO: 225

SEQ ID NO: 353 - DNA, 171 bp, Zea mays derived;; identical to SEQ ID NO: 225

SEQ ID NO: 354 - DNA, 175 bp, Zea mays derived;; identical to SEQ ID NO: 103
  misc_feature (26)..(26): n is a, c, g, or t

SEQ ID NO: 355 - DNA, 175 bp, Zea mays derived;; identical to SEQ ID NO: 103
  misc_feature (26)..(26): n is a, c, g, or t

SEQ ID NO: 356 - DNA, 171 bp, Zea mays derived;; identical to SEQ ID NO: 225

SEQ ID NO: 357 - DNA, 175 bp, Zea mays derived;; identical to SEQ ID NO: 103
  misc_feature (26)..(26): n is a, c, g, or t

SEQ ID NO: 358 - DNA, 171 bp, Zea mays derived;; identical to SEQ ID NO: 225

SEQ ID NO: 359 - DNA, 171 bp, Zea mays derived;; identical to SEQ ID NO: 225

SEQ ID NO: 360 - DNA, 172 bp, Zea mays derived;
tgggaggccggcaagccactgtccgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 361 - DNA, 174 bp, Zea mays derived;; identical to SEQ ID NO: 206

SEQ ID NO: 362 - DNA, 171 bp, Zea mays derived;; identical to SEQ ID NO: 225

SEQ ID NO: 363 - DNA, 171 bp, Zea mays derived;; identical to SEQ ID NO: 225

SEQ ID NO: 364 - DNA, 175 bp, Zea mays derived;; identical to SEQ ID NO: 103
  misc_feature (26)..(26): n is a, c, g, or t

SEQ ID NO: 365 - DNA, 173 bp, Zea mays derived;; identical to SEQ ID NO: 191

SEQ ID NO: 366 - DNA, 175 bp, Zea mays derived;; identical to SEQ ID NO: 103
  misc_feature (26)..(26): n is a, c, g, or t

SEQ ID NO: 367 - DNA, 175 bp, Zea mays derived;; identical to SEQ ID NO: 103
  misc_feature (26)..(26): n is a, c, g, or t

SEQ ID NO: 368 - DNA, 175 bp, Zea mays derived;; identical to SEQ ID NO: 103
  misc_feature (26)..(26): n is a, c, g, or t

SEQ ID NO: 369 - DNA, 175 bp, Zea mays derived;
tgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 370 - DNA, 175 bp, Zea mays derived;; identical to SEQ ID NO: 103
  misc_feature (26)..(26): n is a, c, g, or t

SEQ ID NO: 371 - DNA, 174 bp, Zea mays derived;; identical to SEQ ID NO: 206

SEQ ID NO: 372 - DNA, 174 bp, Zea mays derived;; identical to SEQ ID NO: 199

SEQ ID NO: 373 - DNA, 175 bp, Zea mays derived;; identical to SEQ ID NO: 103
  misc_feature (26)..(26): n is a, c, g, or t

SEQ ID NO: 374 - DNA, 171 bp, Zea mays derived;; identical to SEQ ID NO: 225

SEQ ID NO: 375 - DNA, 175 bp, Zea mays derived;; identical to SEQ ID NO: 235
  misc_feature (26)..(27): n is a, c, g, or t

SEQ ID NO: 376 - DNA, 175 bp, Zea mays derived;; identical to SEQ ID NO: 103
  misc_feature (26)..(26): n is a, c, g, or t

SEQ ID NO: 377 - DNA, 174 bp, Zea mays derived;; identical to SEQ ID NO: 206

SEQ ID NO: 378 - DNA, 162 bp, Zea mays derived;
tgggaggccggcaagccgaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 379 - DNA, 172 bp, Zea mays derived;; identical to SEQ ID NO: 227

SEQ ID NO: 380 - DNA, 156 bp, Zea mays derived;
tgggaggccggcaagccaaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 381 - DNA, 171 bp, Zea mays derived;; identical to SEQ ID NO: 225

SEQ ID NO: 382 - DNA, 172 bp, Zea mays derived;
tgggaggccggcaagccactgtcgaaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 383 - DNA, 174 bp, Zea mays derived;; identical to SEQ ID NO: 199

SEQ ID NO: 384 - DNA, 175 bp, Zea mays derived;; identical to SEQ ID NO: 103
  misc_feature (26)..(26): n is a, c, g, or t

SEQ ID NO: 385 - DNA, 171 bp, Zea mays derived;; identical to SEQ ID NO: 225

SEQ ID NO: 386 - DNA, 171 bp, Zea mays derived;; identical to SEQ ID NO: 225

SEQ ID NO: 387 - DNA, 148 bp, Zea mays derived;
tgggaggccgaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 388 - DNA, 175 bp, Zea mays derived;; identical to SEQ ID NO: 103
  misc_feature (26)..(26): n is a, c, g, or t

SEQ ID NO: 389 - DNA, 172 bp, Zea mays derived;; identical to SEQ ID NO: 227

SEQ ID NO: 390 - DNA, 175 bp, Zea mays derived;; identical to SEQ ID NO: 103
  misc_feature (26)..(26): n is a, c, g, or t

SEQ ID NO: 391 - DNA, 175 bp, Zea mays derived;; identical to SEQ ID NO: 103
  misc_feature (26)..(26): n is a, c, g, or t

SEQ ID NO: 392 - DNA, 174 bp, Zea mays derived;; identical to SEQ ID NO: 206

SEQ ID NO: 393 - DNA, 173 bp, Zea mays derived;; identical to SEQ ID NO: 191

SEQ ID NO: 394 - DNA, 173 bp, Zea mays derived;; identical to SEQ ID NO: 198

SEQ ID NO: 395 - DNA, 171 bp, Zea mays derived;; identical to SEQ ID NO: 225

SEQ ID NO: 396 - DNA, 174 bp, Zea mays derived;; identical to SEQ ID NO: 199

SEQ ID NO: 397 - DNA, 163 bp, Zea mays derived;
tgggaggccggcaacgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 398 - DNA, 175 bp, Zea mays derived;; identical to SEQ ID NO: 103
  misc_feature (26)..(26): n is a, c, g, or t

SEQ ID NO: 399 - DNA, 171 bp, Zea mays derived;; identical to SEQ ID NO: 225

SEQ ID NO: 400 - DNA, 156 bp, Zea mays derived;
tgggaggccggcaagccactgtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 401 - DNA, 148 bp, Zea mays derived;; identical to SEQ ID NO: 387

SEQ ID NO: 402 - DNA, 149 bp, Zea mays derived;
tgggaggccggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 403 - DNA, 171 bp, Zea mays derived;; identical to SEQ ID NO: 225

SEQ ID NO: 404 - DNA, 174 bp, Zea mays derived;; identical to SEQ ID NO: 199

SEQ ID NO: 405 - DNA, 175 bp, Zea mays derived;; identical to SEQ ID NO: 103
  misc_feature (26)..(26): n is a, c, g, or t

SEQ ID NO: 406 - DNA, 165 bp, Zea mays derived;
tgggaggccggcaagccactgaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 407 - DNA, 175 bp, Zea mays derived;; identical to SEQ ID NO: 103
  misc_feature (26)..(26): n is a, c, g, or t

SEQ ID NO: 408 - DNA, 169 bp, Zea mays derived;; identical to SEQ ID NO: 263

SEQ ID NO: 409 - DNA, 175 bp, Zea mays derived;; identical to SEQ ID NO: 103
  misc_feature (26)..(26): n is a, c, g, or t

SEQ ID NO: 410 - DNA, 173 bp, Zea mays derived;; identical to SEQ ID NO: 191

SEQ ID NO: 411 - DNA, 148 bp, Zea mays derived;; identical to SEQ ID NO: 387

SEQ ID NO: 412 - DNA, 175 bp, Zea mays derived;; identical to SEQ ID NO: 103
  misc_feature (26)..(26): n is a, c, g, or t

SEQ ID NO: 413 - DNA, 175 bp, Zea mays derived;; identical to SEQ ID NO: 103
  misc_feature (26)..(26): n is a, c, g, or t

SEQ ID NO: 414 - DNA, 173 bp, Zea mays derived;; identical to SEQ ID NO: 198

SEQ ID NO: 415 - DNA, 148 bp, Zea mays derived;; identical to SEQ ID NO: 387

SEQ ID NO: 416 - DNA, 175 bp, Zea mays derived;; identical to SEQ ID NO: 103
  misc_feature (26)..(26): n is a, c, g, or t

SEQ ID NO: 417 - DNA, 155 bp, Zea mays derived;
tgggaggccggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 418 - DNA, 175 bp, Zea mays derived;; identical to SEQ ID NO: 103
  misc_feature (26)..(26): n is a, c, g, or t

SEQ ID NO: 419 - DNA, 175 bp, Zea mays derived;; identical to SEQ ID NO: 103
  misc_feature (26)..(26): n is a, c, g, or t

SEQ ID NO: 420 - DNA, 171 bp, Zea mays derived;; identical to SEQ ID NO: 225

SEQ ID NO: 421 - DNA, 175 bp, Zea mays derived;; identical to SEQ ID NO: 103
  misc_feature (26)..(26): n is a, c, g, or t

SEQ ID NO: 422 - DNA, 174 bp, Zea mays derived;; identical to SEQ ID NO: 199

SEQ ID NO: 423 - DNA, 173 bp, Zea mays derived;; identical to SEQ ID NO: 191

SEQ ID NO: 424 - DNA, 161 bp, Zea mays derived;
tgggaggccggcaagccactgtcaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 425 - DNA, 173 bp, Zea mays derived;; identical to SEQ ID NO: 191

SEQ ID NO: 426 - DNA, 175 bp, Zea mays derived;; identical to SEQ ID NO: 103
  misc_feature (26)..(26): n is a, c, g, or t

SEQ ID NO: 427 - DNA, 148 bp, Zea mays derived;; identical to SEQ ID NO: 387

SEQ ID NO: 428 - DNA, 169 bp, Zea mays derived;; identical to SEQ ID NO: 263

SEQ ID NO: 429 - DNA, 175 bp, Zea mays derived;
  misc_feature (26)..(29): n is a, c, g, or t
tgggaggccggcaagccactgtcgannnntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatg

SEQ ID NO: 430 - DNA, 175 bp, Zea mays derived;; identical to SEQ ID NO: 103
  misc_feature (26)..(26): n is a, c, g, or t

SEQ ID NO: 431 - DNA, 171 bp, Zea mays derived;; identical to SEQ ID NO: 225

SEQ ID NO: 432 - DNA, 164 bp, Zea mays derived;
tgggaggccggcaagccaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 433 - DNA, 171 bp, Zea mays derived;; identical to SEQ ID NO: 225

SEQ ID NO: 434 - DNA, 175 bp, Zea mays derived;; identical to SEQ ID NO: 103
  misc_feature (26)..(26): n is a, c, g, or t

SEQ ID NO: 435 - DNA, 159 bp, Zea mays derived;
tgggaggccggcaagccatggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 436 - DNA, 171 bp, Zea mays derived;; identical to SEQ ID NO: 225

SEQ ID NO: 437 - DNA, 148 bp, Zea mays derived;
tgggaggccggcgtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 438 - DNA, 168 bp, Zea mays derived;; identical to SEQ ID NO: 279

SEQ ID NO: 439 - DNA, 173 bp, Zea mays derived;; identical to SEQ ID NO: 269

SEQ ID NO: 440 - DNA, 168 bp, Zea mays derived;; identical to SEQ ID NO: 190

SEQ ID NO: 441 - DNA, 169 bp, Zea mays derived;; identical to SEQ ID NO: 263

SEQ ID NO: 442 - DNA, 173 bp, Zea mays derived;; identical to SEQ ID NO: 191

SEQ ID NO: 443 - DNA, 174 bp, Zea mays derived;; identical to SEQ ID NO: 199

SEQ ID NO: 444 - DNA, 174 bp, Zea mays derived;; identical to SEQ ID NO: 199

SEQ ID NO: 445 - DNA, 175 bp, Zea mays derived;
  misc_feature (26)..(38): n is a, c, g, or t
tgggaggccggcaagccactgtcgannnnnnnnnnnnntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtca

SEQ ID NO: 446 - DNA, 171 bp, Zea mays derived;; identical to SEQ ID NO: 225

SEQ ID NO: 447 - DNA, 172 bp, Zea mays derived;; identical to SEQ ID NO: 360

SEQ ID NO: 448 - DNA, 171 bp, Zea mays derived;; identical to SEQ ID NO: 225

SEQ ID NO: 449 - DNA, 174 bp, Zea mays derived;; identical to SEQ ID NO: 199

SEQ ID NO: 450 - DNA, 174 bp, Zea mays derived;; identical to SEQ ID NO: 206

SEQ ID NO: 451 - DNA, 175 bp, Zea mays derived;; identical to SEQ ID NO: 103
  misc_feature (26)..(26): n is a, c, g, or t

SEQ ID NO: 452 - DNA, 171 bp, Zea mays derived;; identical to SEQ ID NO: 225

SEQ ID NO: 453 - DNA, 175 bp, Zea mays derived;; identical to SEQ ID NO: 103
  misc_feature (26)..(26): n is a, c, g, or t

SEQ ID NO: 454 - DNA, 175 bp, Zea mays derived;; identical to SEQ ID NO: 103
  misc_feature (26)..(26): n is a, c, g, or t

SEQ ID NO: 455 - DNA, 171 bp, Zea mays derived;; identical to SEQ ID NO: 225

SEQ ID NO: 456 - DNA, 175 bp, Zea mays derived;; identical to SEQ ID NO: 103
  misc_feature (26)..(26): n is a, c, g, or t

SEQ ID NO: 457 - DNA, 171 bp, Zea mays derived;; identical to SEQ ID NO: 225

SEQ ID NO: 458 - DNA, 172 bp, Zea mays derived;
tgggaggccggcaagccactgtcggaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 459 - DNA, 175 bp, Zea mays derived;; identical to SEQ ID NO: 103
  misc_feature (26)..(26): n is a, c, g, or t

SEQ ID NO: 460 - DNA, 172 bp, Zea mays derived;; identical to SEQ ID NO: 458

SEQ ID NO: 461 - DNA, 175 bp, Zea mays derived;; identical to SEQ ID NO: 103
  misc_feature (26)..(26): n is a, c, g, or t

SEQ ID NO: 462 - DNA, 171 bp, Zea mays derived;; identical to SEQ ID NO: 225

SEQ ID NO: 463 - DNA, 171 bp, Zea mays derived;; identical to SEQ ID NO: 225

SEQ ID NO: 464 - DNA, 175 bp, Zea mays derived;; identical to SEQ ID NO: 103
  misc_feature (26)..(26): n is a, c, g, or t

SEQ ID NO: 465 - DNA, 171 bp, Zea mays derived;; identical to SEQ ID NO: 225

SEQ ID NO: 466 - DNA, 175 bp, Zea mays derived;
  misc_feature (26)..(34): n is a, c, g, or t
tgggaggccggcaagccactgtcgannnnnnnnntcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtag

SEQ ID NO: 467 - DNA, 173 bp, Zea mays derived;; identical to SEQ ID NO: 191

SEQ ID NO: 468 - DNA, 171 bp, Zea mays derived;; identical to SEQ ID NO: 225

SEQ ID NO: 469 - DNA, 168 bp, Zea mays derived;; identical to SEQ ID NO: 265

SEQ ID NO: 470 - DNA, 175 bp, Zea mays derived;; identical to SEQ ID NO: 103
  misc_feature (26)..(26): n is a, c, g, or t

SEQ ID NO: 471 - DNA, 175 bp, Zea mays derived;; identical to SEQ ID NO: 103
  misc_feature (26)..(26): n is a, c, g, or t

SEQ ID NO: 472 - DNA, 171 bp, Zea mays derived;; identical to SEQ ID NO: 225

SEQ ID NO: 473 - DNA, 174 bp, Zea mays derived;; identical to SEQ ID NO: 206

SEQ ID NO: 474 - DNA, 153 bp, Zea mays derived;
tgggaggccgggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 475 - DNA, 175 bp, Zea mays derived;; identical to SEQ ID NO: 103
  misc_feature (26)..(26): n is a, c, g, or t

SEQ ID NO: 476 - DNA, 170 bp, Zea mays derived;
tgggaggccggcaagccactgtcgagaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 477 - DNA, 175 bp, Zea mays derived;; identical to SEQ ID NO: 103
  misc_feature (26)..(26): n is a, c, g, or t

SEQ ID NO: 478 - DNA, 171 bp, Zea mays derived;; identical to SEQ ID NO: 225

SEQ ID NO: 479 - DNA, 173 bp, Zea mays derived;; identical to SEQ ID NO: 191

SEQ ID NO: 480 - DNA, 161 bp, Zea mays derived;
tgggaggccggtcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 481 - DNA, 171 bp, Zea mays derived;; identical to SEQ ID NO: 225

SEQ ID NO: 482 - DNA, 160 bp, Zea mays derived;; identical to SEQ ID NO: 195

SEQ ID NO: 483 - DNA, 168 bp, Zea mays derived;
tgggaggccggcaagccaccgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 484 - DNA, 162 bp, Zea mays derived;
tgggaggccggcaagccactgtcgaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 485 - DNA, 175 bp, Zea mays derived;; identical to SEQ ID NO: 103
  misc_feature (26)..(26): n is a, c, g, or t

SEQ ID NO: 486 - DNA, 162 bp, Zea mays derived;
tgggaggccggcaagccaaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 487 - DNA, 171 bp, Zea mays derived;; identical to SEQ ID NO: 225

SEQ ID NO: 488 - DNA, 165 bp, Zea mays derived;; identical to SEQ ID NO: 406

SEQ ID NO: 489 - DNA, 171 bp, Zea mays derived;; identical to SEQ ID NO: 225

SEQ ID NO: 490 - DNA, 153 bp, Zea mays derived;
tgggaggccggcaagccatagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 491 - DNA, 168 bp, Zea mays derived;; identical to SEQ ID NO: 483

SEQ ID NO: 492 - DNA, 173 bp, Zea mays derived;; identical to SEQ ID NO: 191

SEQ ID NO: 493 - DNA, 167 bp, Zea mays derived;
tgggaggccggcaagccactaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 494 - DNA, 175 bp, Zea mays derived;; identical to SEQ ID NO: 103
  misc_feature (26)..(26): n is a, c, g, or t

SEQ ID NO: 495 - DNA, 165 bp, Zea mays derived;
tgggaggccggcaagccaaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 496 - DNA, 158 bp, Zea mays derived;
tgggaggccggcaagccactgtctagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 497 - DNA, 175 bp, Zea mays derived;; identical to SEQ ID NO: 103
  misc_feature (26)..(26): n is a, c, g, or t

SEQ ID NO: 498 - DNA, 174 bp, Zea mays derived;; identical to SEQ ID NO: 199

SEQ ID NO: 499 - DNA, 175 bp, Zea mays derived;; identical to SEQ ID NO: 103
  misc_feature (26)..(26): n is a, c, g, or t

SEQ ID NO: 500 - DNA, 166 bp, Zea mays derived;; identical to SEQ ID NO: 333

SEQ ID NO: 501 - DNA, 175 bp, Zea mays derived;; identical to SEQ ID NO: 103
  misc_feature (26)..(26): n is a, c, g, or t

SEQ ID NO: 502 - DNA, 170 bp, Zea mays derived;
tgggaggccggcaagccactgcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 503 - DNA, 171 bp, Zea mays derived;; identical to SEQ ID NO: 225

SEQ ID NO: 504 - DNA, 175 bp, Zea mays derived;; identical to SEQ ID NO: 103
  misc_feature (26)..(26): n is a, c, g, or t

SEQ ID NO: 505 - DNA, 175 bp, Zea mays derived;; identical to SEQ ID NO: 103
  misc_feature (26)..(26): n is a, c, g, or t

SEQ ID NO: 506 - DNA, 171 bp, Zea mays derived;; identical to SEQ ID NO: 225

SEQ ID NO: 507 - DNA, 175 bp, Zea mays derived;; identical to SEQ ID NO: 103
  misc_feature (26)..(26): n is a, c, g, or t

SEQ ID NO: 508 - DNA, 164 bp, Zea mays derived;
tgggaggccggcaagccactgtctggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 509 - DNA, 175 bp, Zea mays derived;; identical to SEQ ID NO: 103
  misc_feature (26)..(26): n is a, c, g, or t

SEQ ID NO: 510 - DNA, 175 bp, Zea mays derived;; identical to SEQ ID NO: 369

SEQ ID NO: 511 - DNA, 175 bp, Zea mays derived;; identical to SEQ ID NO: 103
  misc_feature (26)..(26): n is a, c, g, or t

SEQ ID NO: 512 - DNA, 160 bp, Zea mays derived;; identical to SEQ ID NO: 195

SEQ ID NO: 513 - DNA, 14909 bp, Artificial sequence
  synthesized vector
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttcctcaatgaaaaagaagagtctgttattaaatttaaattgacgtgctgaactgacatttcgatttcaaattgacctcaagaacaagagaacgcgtaaacattatttgttcttcatttatttctatggttgaagtgatcttaagatttgttcttgaataaaaaaatatttaatgttcattaagtatcttccataaaaatatctttttcgcctcttgatttagttatttattaatattattgtaagtgtttacataagttcgtgatttatcgtaactttagaattattgaatcaaagttctatgatcctaaacatgtttacacctagctagttgttaaaaaaatcaactttcattaagattccttgtttacttttaaaattcaacttttaaattttttatgtcattcactttaatatcgtgcaatacacattattaatcccaaattatagtctgtaaataattgtaaggaaagtataaaatattatgcaacgacaattttcattgagtgttagacgtttatttataaacttaccaaaacaaaggcgtttatggtaattaaaaacacaagagtttaagttttatatcaatttaaaaaaaaattgtttcaaatataactcttaaagtaattattattattataaaaattattattctcatcatatatataagataatctataactagatgagaatataatttttttttaaaatattaatccatttttattaaatccaaatatatctatgaaacaattggggtacttgggtaaatgcatcatgtaacatacgaactacctacgactatgagggttcaccttctttaaggttagttcctgaatccgtcagctgaaaatcgagtcctctcccacttcacatttcgacacgtggcactgttgtgacatattctctccaatcatcgttagtcatcagtgaccctatttagggcttctcccatttttcttccaaatttccattaccaacccctcgttaatctcctttgctctttctttatccaccgtctgatcccttcctacttttctatcaactgtgctcccacctatgtgtttgaatttaagttagaaatacagtacatgtgatttcatgtaaatttaatggataaaaataagttgaaaagaaaaactagagtaatgatgcttctccaaaggtatgtttgtctcgaaagtacgtttgtaattttctactcaaacacacttttaatatctattttatacttaattttgaattttaagaataaataattaaatttgttcttaaaaatatgagatgttaataaattaatcctaaaaaataaaaaatttaaatttaatctatgaatatatacaaaataagataaattagttatgtagataatttaatgacaaattaatttctaaattttataatttaatgttaaacttttaaaaaaaatattttttttatcaaattgataagtgagtattataacttaataataaaataatcttacaaatttatattaatttatcatacttttaacatgtggagataataaatttatattttttatttttcaacaacaatttgttaccgaatcaaattttggaaaacaaatttaattatttattcaaattttgatttgagcagtttccttggcccggtccttatcattaatcaaagcacaggccacaggtgatgtatgaagcaaattaagccaagagaaaaagacaggtagagagagaaatttgattttggttttggagttagcatccattaccattcccatttgacctgataaggatgcttttgctgggattcttaattaaggaggtagaatacaattaattaacaatacacgtacctcttagtatcacactttagacttaacattttcaaaatatatttctagatacctgttatatacaaggcctacatatatatattatagagattttatacattctaaattttgtgagtgtggacatactctgagcgtgagaaagagaaggggaagaaagagagagagtgctgggaaggggaagagtggagttgaagagaattgagaacaagatcaacaggcaagtgacctttgcaaaacgaaggaacgggcttttgaagaaagcttctgagctttccgttctttgtgctgccgaggttgctctcatcatcttctccaatagaggaaagcagtacgagttttgcagcggttcaaggtattttcccccccaccaaaatgcaaaaacaaaaatggataattataaacacatggaatggacacaacatagcataaccaagaaaaaaaaaaaatcctttctctctctctctctctccttttgtttacttcttcaaacacatatggttatatgtgcacataaaacatactatcaccgaaaaaggaaccgcaggacctttctagttctcatccacacctttctctcttcctttgatttttgctgttttcagtgattcaagaccaccagctagcgtttgccaccttctcaatttttatttttttttatgcaaacaacatgaaaaaagttgagtttcttttttcactgttttgagtttttccgtttctgtgaatgtctcggcgtttttagcaggttgagtgtttctgtggtcttgttgatgttagatctgcaactggaaatgcaaagaaatataaatacaataaaacaacatgagagattattactgttgtattgactgttctattctatgtatgtgctagtttttttttcttccttcttctctaattttgttttcccccaaccctttaccaccattctctttcttaccctcttttggctctcaacccagtgatccaaaatttatttatttttgcttcatttgtgttaagtttcaagcagatctggttttaaagttttccccaaaagcaatttgggatctgctcatcaggcttctgtttctgtgcaattaagtgttgtgtaaagatgcacatcattatttttttttccatgtcaagttttagcagccagtgtctgcttttggcttcagtgtttaagaatcagtcgaaaaacctaacccatgtctcctttttcattttcttatttcacccaaggcaaggtactatcgtttacatatatctctgggcctagctagggtttcttttatttctacaattagttcttagtttcctcagtatatatatctgtccatttcttcccttttcatgtattatttaaaagttatatttttttattattatttgcgttggcttactatttttcctatattatttatttactcatcaagctttatgatggtactaattctctgccctaatttactcatttcttttttttttttcagttgtatacatatgttatgttattgaaagcagatgtacatttgatatgttttttcaattgataattatcatgatgaatttaattattacaggttgatatgcttatgctactaaatcaggattagatcgaatggtcttttcttatagggcatctagtatagtatagtggataatttgacctctatctccttaagcataaacgcactgccacatttttcaattcattcagttgtatatgtttcgatgcctagctaatagctagacataccaagattttctttctggatatatattggcttctcagtacaaattttcttcttccaaaactagctgctctctctctctctcgttcagaaatcaacagtggtccattaggtcaggatctcaatgtacggtaatcgaacaatgatatgttccctgtatctacttctgggcgtttaagaagtgtcacataaattaaatgagctatatatctcatttattatccataggatatatatccgatcgatttctttctcttgccacatttagtttgttactagcttttatctagcgatagatgaatagtatgtttggggtgacactaagatcaaccaaaatcaattatcaaatcacagtaaagtaaatgtgaaataatatataattcttttggaaaaatcatggtgatattgcttgtgtgaaacgggatttctatttgattcccaaacacactagaaaggggtctcaattatatattcacatcttaaactactaattagttatcgatcctgctcacacaaggtgtattctgacgtctctctccatttattaccgggttaattggtttctcatcactataagttgttcaccgcttgagaaaacataatcttttggctaggtggagttggacttacagaaaatttgaagtcaaaagatgtttcaagagaagacacaatttatacttaataatattattaattttgaaacccttactaaagaaagtacgttaattaattatgcagtaattaacttactatagttttccttttttaaaaactttcttggatgcgtaagtactactgattgtgcatctgtcctgtagtaatggaattatacatttaattggtacttatatgatattctaaatgtttgtacataattttatatatgtcaacgtgcagcctgctcaaaacgctatggataagaagtattctattggacttgatattggaaccaactctgtgggatgggctgttattactgacgagtataaggttccatctaagaagttcaaggttcttggaaacactgatagacactctattaagaagaaccttattggtgctcttcttttcgattctggagagactgctgaggctactagacttaagagaactgctagaagaagatatactagaagaaagaacagaatttgctatcttcaagagattttctctaacgagatggctaaggttgacgattctttcttccacagacttgaggagtctttccttgttgaggaggataagaagcacgagagacacccaattttcggaaacattgttgacgaggttgcttatcacgagaagtatccaactatttatcaccttagaaagaagctcgttgattctactgataaggctgatcttagacttatttatcttgctcttgctcacatgattaagttcagaggacacttccttattgagggagatcttaacccagataactctgacgttgataagctcttcattcaacttgttcaaacttataaccaacttttcgaggagaacccaattaacgcttctggagttgacgctaaggctattctttctgctagactttctaagtctagaaggcttgagaaccttattgctcaacttccaggagagaagaagaacggacttttcggaaaccttattgctctttctcttggacttactccaaacttcaagtctaacttcgatcttgctgaggacgctaagctccaactttctaaggatacttacgacgatgatcttgataaccttcttgctcaaattggagatcaatacgctgatcttttccttgctgctaagaacctttctgacgctattcttctttctgatattcttagagttaacactgagattactaaggctccactttctgcttctatgattaagagatacgacgagcaccaccaagatcttactcttcttaaggctcttgttagacaacaacttccagagaagtataaggagattttcttcgatcaatctaagaacggatacgctggatatattgacggaggagcttctcaagaggagttctataagttcattaagccaattcttgagaagatggacggaactgaggagcttcttgttaagctcaacagagaggatcttcttagaaagcaaagaactttcgataacggatctattccacaccaaattcaccttggagagcttcacgctattcttagaaggcaagaggatttctatccattccttaaggataacagagagaagattgagaagattcttactttccgtattccatattacgttggaccacttgctagaggaaactctagattcgcttggatgactagaaagtctgaggagactattactccttggaacttcgaggaggttgttgataagggagcttctgctcaatctttcattgagagaatgactaacttcgataagaaccttccaaacgagaaggttcttccaaagcactctcttctttacgagtatttcactgtttataacgagcttactaaggttaagtacgttactgagggaatgagaaagccagctttcctttctggagagcaaaagaaggctattgttgatcttcttttcaagactaacagaaaggttactgttaagcaacttaaggaggattatttcaagaagattgagtgcttcgattctgttgagatttctggagttgaggatagattcaacgcttctcttggaacttatcacgatcttcttaagattattaaggataaggatttccttgataacgaggagaacgaggatattcttgaggatattgttcttactcttactcttttcgaggatagagagatgattgaggagagacttaagacttacgctcaccttttcgacgataaggttatgaagcaacttaagagaagaagatatactggatggggtagactttctagaaagctcattaacggaattagagataagcaatctggaaagactattcttgatttccttaagtctgacggattcgctaacagaaacttcatgcaacttattcacgacgattctcttactttcaaggaggatattcaaaaggctcaagtttctggacaaggagattctcttcacgagcacattgctaaccttgctggatctccagctattaagaagggaattcttcaaactgttaaggttgttgacgagcttgttaaggttatgggtagacacaagccagagaacattgttattgagatggctagagagaaccaaactactcaaaagggacaaaagaactctagagagagaatgaagagaattgaggagggaattaaggagcttggatctcaaattcttaaggagcacccagttgagaacactcaacttcaaaacgagaagctctatctttattatcttcaaaacggaagagatatgtacgttgatcaagagcttgatattaacagactttctgattacgacgttgatcacattgttccacaatctttccttaaggacgattctattgataacaaggttcttactagatctgataagaacagaggaaagtctgataacgttccatctgaggaggttgttaagaagatgaagaactattggagacaacttcttaacgctaagctcattactcaaagaaagttcgataaccttactaaggctgagagaggaggactttctgagcttgataaggctggattcattaagagacaacttgttgagactagacaaattactaagcacgttgctcaaattcttgattctagaatgaacactaagtacgacgagaacgataagctcattagagaggttaaggttattactcttaagtctaagctcgtttctgatttcagaaaggatttccaattctataaggttagagagattaacaactatcaccacgctcacgacgcttatcttaacgctgttgttggaactgctcttattaagaagtatccaaaacttgagtctgagttcgtttacggagattataaggtttacgacgttagaaagatgattgctaagtctgagcaagagattggaaaggctactgctaagtatttcttctattctaacattatgaacttcttcaagactgagattactcttgctaacggagagattagaaagaggccacttattgagactaacggagagactggagagattgtttgggataagggaagagatttcgctactgttagaaaggttctttctatgccacaagttaacattgttaagaaaactgaggttcaaactggaggattctctaaggagtctattcttccaaagagaaactctgataagctcattgctagaaagaaggattgggacccaaagaagtacggaggattcgattctccaactgttgcttattctgttcttgttgttgctaaggttgagaagggaaagtctaagaagctcaagtctgttaaggagcttgttggaattactattatggagagatcttctttcgagaagaacccagttgatttccttgaggctaagggatataaggaggttaagaaggatcttattattaagctcccaaagtattctcttttcgagcttgagaacggaagaaagagaatgcttgcttctgctggagagcttcaaaagggaaacgagcttgctcttccatctaagtacgttaacttcctttatcttgcttctcactacgagaagctcaagggatctccagaggataacgagcaaaagcaacttttcgttgagcaacacaagcactatcttgacgagattattgagcaaatttctgagttctctaagagagttattcttgctgacgctaaccttgataaggttctttctgcttataacaagcacagagataagccaattagagagcaagctgagaacattattcaccttttcactcttactaaccttggtgctccagctgctttcaagtatttcgatactactattgatagaaagagatatacttctactaaggaggttcttgacgctactcttattcaccaatctattactggactttacgagactagaattgatctttctcaacttggaggagattcttctccaccaaagaagaagagaaaggtttcttggaaggacgcttctggatggtctagaatgtgaaagagtgtcaaatgtggagcataattaaagatcctgccgtttaatttcaaatttatttgaagttaaggaaaacggaaatttgtaatagcacgtaatggacttacactagactctaccttctaattaagctaggaacaatataagcagtgattttgtgtgtgagctttcataaacagtacctagctagcctcttccttgtttcaataatcacttcttccttttcctaattaataaaactatcgtatgcaccctttgcctttacattaccttgtattacctaccaatgacctcacatgtttgcttttgtcactctataaaattagtgtttaattttctcttccaggcatagccattatttgatggggtgaaaatgcttgtattatgaaaatatacatttctcaattgaaaacttatcacatgatagtaaactaagtggttatagaaaaaaaatagttaaatgcacaaaaataatgaaaggctgctagtcactcaaattttataaagaatttataagtgagaagtctacaaacacttttttaataaggtgaattgtttcgtaattaatttcatttcgtttaaaaaaataatttgtaacacgttaattaattttactattaaaaagattaaattatatcataactaattaaatttcaattaaaacatttattgtatcataatttcaattaaaaaatttattgtatcataattaattttaatattaaaaggataaattatatcataactaatcatttagttttgttaaagattattaatgataaatgctcctgtgtctcgtataagttatacaacgaaaacaattttgttgaaaaaagacacattaaaaacttatttttataaaaaaaaaattgtccaaaacaaaattgaggtgtaaatttagagaaaacatttgtttccagcactccgactattatattctgtatctctaattatatattggaaaatccattttgacataaaaatttatattttagaataaactaagcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgataccggatttgcgagaagcgttttagagctagaaatagcaagttaaaataaggctagtccgttatcaacttgaaaaagtggcaccgagtcggtgctttttttttaactaattaaagaaaataaaaatgcaagtgcggtgacaagacaagctagaataaagttgcaaagaaatgacagggctacaaaaggctcacctacttctggatttaccaaacttctgtttgtccccatactccaaaaacaaaaccatttttttttatcttcgtttttgtttgctttgactgtgagttgaggcccaactttctgcttctgtccgactctatttgatgaattttgtttgcctcctgtgatgtgaaggatgtatcattgaaagggaacgtgtctcaatgatcccacatcggccaaatatgctcattacattgcgtttatatagtcccaggaaaacatatggattggaaggaagaagaggcgcaatgttttagagctagaaatagcaagttaaaataaggctagtccgttatcaacttgaaaaagtggcaccgagtcggtgctttttttttaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagaattcaagcttgatatcggaagtttctctcttgagggaggttgctcgtggaatgggacacatatggttgttataataaaccatttccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatgtctactgtttttattgattcaatatttgattgttcttttttttgcagatttgttgaccagatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccgtccagcaactgctcgtaagtcctctggtctttctggaaccgtccgtattccaggtgacaagtctatctcccacaggtccttcatgtttggaggtctcgctagcggtgaaactcgtatcaccggtcttttggaaggtgaagatgttatcaacactggtaaggctatgcaagctatgggtgccagaatccgtaaggaaggtgatacttggatcattgatggtgttggtaacggtggactccttgctcctgaggctcctctcgatttcggtaacgctgcaactggttgccgtttgactatgggtcttgttggtgtttacgatttcgatagcactttcattggtgacgcttctctcactaagcgtccaatgggtcgtgtgttgaacccacttcgcgaaatgggtgtgcaggtgaagtctgaagacggtgatcgtcttccagttaccttgcgtggaccaaagactccaacgccaatcacctacagggtacctatggcttccgctcaagtgaagtccgctgttctgcttgctggtctcaacaccccaggtatcaccactgttatcgagccaatcatgactcgtgaccacactgaaaagatgcttcaaggttttggtgctaaccttaccgttgagactgatgctgacggtgtgcgtaccatccgtcttgaaggtcgtggtaagctcaccggtcaagtgattgatgttccaggtgatccatcctctactgctttcccattggttgctgccttgcttgttccaggttccgacgtcaccatccttaacgttttgatgaacccaacccgtactggtctcatcttgactctgcaggaaatgggtgccgacatcgaagtgatcaacccacgtcttgctggtggagaagacgtggctgacttgcgtgttcgttcttctactttgaagggtgttactgttccagaagaccgtgctccttctatgatcgacgagtatccaattctcgctgttgcagctgcattcgctgaaggtgctaccgttatgaacggtttggaagaactccgtgttaaggaaagcgaccgtctttctgctgtcgcaaacggtctcaagctcaacggtgttgattgcgatgaaggtgagacttctctcgtcgtgcgtggtcgtcctgacggtaagggtctcggtaacgcttctggagcagctgtcgctacccacctcgatcaccgtatcgctatgagcttcctcgttatgggtctcgtttctgaaaaccctgttactgttgatgatgctactatgatcgctactagcttcccagagttcatggatttgatggctggtcttggagctaagatcgaactctccgacactaaggctgcttgaagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 514 - DNA, 4478 bp, Glycine max derived;
tcaatgaaaaagaagagtctgttattaaatttaaattgacgtgctgaactgacatttcgatttcaaattgacctcaagaacaagagaacgcgtaaacattatttgttcttcatttatttctatggttgaagtgatcttaagatttgttcttgaataaaaaaatatttaatgttcattaagtatcttccataaaaatatctttttcgcctcttgatttagttatttattaatattattgtaagtgtttacataagttcgtgatttatcgtaactttagaattattgaatcaaagttctatgatcctaaacatgtttacacctagctagttgttaaaaaaatcaactttcattaagattccttgtttacttttaaaattcaacttttaaattttttatgtcattcactttaatatcgtgcaatacacattattaatcccaaattatagtctgtaaataattgtaaggaaagtataaaatattatgcaacgacaattttcattgagtgttagacgtttatttataaacttaccaaaacaaaggcgtttatggtaattaaaaacacaagagtttaagttttatatcaatttaaaaaaaaattgtttcaaatataactcttaaagtaattattattattataaaaattattattctcatcatatatataagataatctataactagatgagaatataatttttttttaaaatattaatccatttttattaaatccaaatatatctatgaaacaattggggtacttgggtaaatgcatcatgtaacatacgaactacctacgactatgagggttcaccttctttaaggttagttcctgaatccgtcagctgaaaatcgagtcctctcccacttcacatttcgacacgtggcactgttgtgacatattctctccaatcatcgttagtcatcagtgaccctatttagggcttctcccatttttcttccaaatttccattaccaacccctcgttaatctcctttgctctttctttatccaccgtctgatcccttcctacttttctatcaactgtgctcccacctatgtgtttgaatttaagttagaaatacagtacatgtgatttcatgtaaatttaatggataaaaataagttgaaaagaaaaactagagtaatgatgcttctccaaaggtatgtttgtctcgaaagtacgtttgtaattttctactcaaacacacttttaatatctattttatacttaattttgaattttaagaataaataattaaatttgttcttaaaaatatgagatgttaataaattaatcctaaaaaataaaaaatttaaatttaatctatgaatatatacaaaataagataaattagttatgtagataatttaatgacaaattaatttctaaattttataatttaatgttaaacttttaaaaaaaatattttttttatcaaattgataagtgagtattataacttaataataaaataatcttacaaatttatattaatttatcatacttttaacatgtggagataataaatttatattttttatttttcaacaacaatttgttaccgaatcaaattttggaaaacaaatttaattatttattcaaattttgatttgagcagtttccttggcccggtccttatcattaatcaaagcacaggccacaggtgatgtatgaagcaaattaagccaagagaaaaagacaggtagagagagaaatttgattttggttttggagttagcatccattaccattcccatttgacctgataaggatgcttttgctgggattcttaattaaggaggtagaatacaattaattaacaatacacgtacctcttagtatcacactttagacttaacattttcaaaatatatttctagatacctgttatatacaaggcctacatatatatattatagagattttatacattctaaattttgtgagtgtggacatactctgagcgtgagaaagagaaggggaagaaagagagagagtgctgggaaggggaagagtggagttgaagagaattgagaacaagatcaacaggcaagtgacctttgcaaaacgaaggaacgggcttttgaagaaagcttctgagctttccgttctttgtgctgccgaggttgctctcatcatcttctccaatagaggaaagcagtacgagttttgcagcggttcaaggtattttcccccccaccaaaatgcaaaaacaaaaatggataattataaacacatggaatggacacaacatagcataaccaagaaaaaaaaaaaatcctttctctctctctctctctccttttgtttacttcttcaaacacatatggttatatgtgcacataaaacatactatcaccgaaaaaggaaccgcaggacctttctagttctcatccacacctttctctcttcctttgatttttgctgttttcagtgattcaagaccaccagctagcgtttgccaccttctcaatttttatttttttttatgcaaacaacatgaaaaaagttgagtttcttttttcactgttttgagtttttccgtttctgtgaatgtctcggcgtttttagcaggttgagtgtttctgtggtcttgttgatgttagatctgcaactggaaatgcaaagaaatataaatacaataaaacaacatgagagattattactgttgtattgactgttctattctatgtatgtgctagtttttttttcttccttcttctctaattttgttttcccccaaccctttaccaccattctctttcttaccctcttttggctctcaacccagtgatccaaaatttatttatttttgcttcatttgtgttaagtttcaagcagatctggttttaaagttttccccaaaagcaatttgggatctgctcatcaggcttctgtttctgtgcaattaagtgttgtgtaaagatgcacatcattatttttttttccatgtcaagttttagcagccagtgtctgcttttggcttcagtgtttaagaatcagtcgaaaaacctaacccatgtctcctttttcattttcttatttcacccaaggcaaggtactatcgtttacatatatctctgggcctagctagggtttcttttatttctacaattagttcttagtttcctcagtatatatatctgtccatttcttcccttttcatgtattatttaaaagttatatttttttattattatttgcgttggcttactatttttcctatattatttatttactcatcaagctttatgatggtactaattctctgccctaatttactcatttcttttttttttttcagttgtatacatatgttatgttattgaaagcagatgtacatttgatatgttttttcaattgataattatcatgatgaatttaattattacaggttgatatgcttatgctactaaatcaggattagatcgaatggtcttttcttatagggcatctagtatagtatagtggataatttgacctctatctccttaagcataaacgcactgccacatttttcaattcattcagttgtatatgtttcgatgcctagctaatagctagacataccaagattttctttctggatatatattggcttctcagtacaaattttcttcttccaaaactagctgctctctctctctctcgttcagaaatcaacagtggtccattaggtcaggatctcaatgtacggtaatcgaacaatgatatgttccctgtatctacttctgggcgtttaagaagtgtcacataaattaaatgagctatatatctcatttattatccataggatatatatccgatcgatttctttctcttgccacatttagtttgttactagcttttatctagcgatagatgaatagtatgtttggggtgacactaagatcaaccaaaatcaattatcaaatcacagtaaagtaaatgtgaaataatatataattcttttggaaaaatcatggtgatattgcttgtgtgaaacgggatttctatttgattcccaaacacactagaaaggggtctcaattatatattcacatcttaaactactaattagttatcgatcctgctcacacaaggtgtattctgacgtctctctccatttattaccgggttaattggtttctcatcactataagttgttcaccgcttgagaaaacataatcttttggctaggtggagttggacttacagaaaatttgaagtcaaaagatgtttcaagagaagacacaatttatacttaataatattattaattttgaaacccttactaaagaaagtacgttaattaattatgcagtaattaacttactatagttttccttttttaaaaactttcttggatgcgtaagtactactgattgtgcatctgtcctgtagtaatggaattatacatttaattggtacttatatgatattctaaatgtttgtacataattttatatatgtcaacgtgcagcctgctcaaaacgct

SEQ ID NO: 515 - DNA, 1000 bp, Glycine max derived;
aagagtgtcaaatgtggagcataattaaagatcctgccgtttaatttcaaatttatttgaagttaaggaaaacggaaatttgtaatagcacgtaatggacttacactagactctaccttctaattaagctaggaacaatataagcagtgattttgtgtgtgagctttcataaacagtacctagctagcctcttccttgtttcaataatcacttcttccttttcctaattaataaaactatcgtatgcaccctttgcctttacattaccttgtattacctaccaatgacctcacatgtttgcttttgtcactctataaaattagtgtttaattttctcttccaggcatagccattatttgatggggtgaaaatgcttgtattatgaaaatatacatttctcaattgaaaacttatcacatgatagtaaactaagtggttatagaaaaaaaatagttaaatgcacaaaaataatgaaaggctgctagtcactcaaattttataaagaatttataagtgagaagtctacaaacacttttttaataaggtgaattgtttcgtaattaatttcatttcgtttaaaaaaataatttgtaacacgttaattaattttactattaaaaagattaaattatatcataactaattaaatttcaattaaaacatttattgtatcataatttcaattaaaaaatttattgtatcataattaattttaatattaaaaggataaattatatcataactaatcatttagttttgttaaagattattaatgataaatgctcctgtgtctcgtataagttatacaacgaaaacaattttgttgaaaaaagacacattaaaaacttatttttataaaaaaaaaattgtccaaaacaaaattgaggtgtaaatttagagaaaacatttgtttccagcactccgactattatattctgtatctctaattatatattggaaaatccattttgacataaaaatttatattttagaataaact

SEQ ID NO: 516 - DNA, 12292 bp, Artificial sequence
  synthesized vector
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagaattcgagacacttgtgtgattgagagaaacactaatcttgtgaggactgaagtttggtgattatttcttgtgatctgtcgacaaaaatatcaaatggggtttcttttacaaattatttacctaaatgaatctgttttgaaaatatttactccattgggtctatttttttattacaaagcgtctccctgaagggcgcgttccccgtgaaagtgacacgtggcaggacttgggacgtgccctgcgtacaggcgcgatagttagtgttgttacagcaggcgcatcgggtcgtgttggggaccaaggtacgacaggtcgcgctgggtgacccagacacgacccaattgggtcgcactttatttaatattttttatattttgtatattgtttttatttaatatatttttatattattttatttaatttttttatattttatataatagtttctatattaaataaattcttagcattatgtatgattttaaagtcataaataattttttatattgtttttatttactatattttttatattttatttaatatttatatattaaataaatccttcatattagaaaaaataaagaaaatattaaataaaatataaaatataaaaaagtaaaaaatattaaataaaataatataaaaaatattataaaaacaatataaaaaatataaaaatatttaataaaataataaaaaaaatattattttaaataaaattatttatgactttaaactctaaagttgaattttaaaaaaatataatttttttacgattttagtaaaaaaaaaatacaagccgcacaatacaagtcgccttctcaaacccttcctcacgacattctcggaccttatgacaccgtcaccaaaacaatgatccacgcgatattaggcgcgtgcaaatcactctaatccgaaactagtagacatgggaagcacgagctatacgcgagcgtttcaattgccgccacgaaagcagagaaggccagaaacggaaccacggtaaaatggtaagggtattttcgtaaacagaagaaaagagttgtagctataaataaaccctctaacccacggcgcactatttctcttcactccttcgttcactcttcttctcttgcggctagggttttagcgcagcttcttctaggttcgttctcttccgccgctctatggattttaaaccttcgaatcatgtttattccattgaattatgttgcttgcagtttatattttctgaatctgtagttgttgtcttcaatttatcctatgctttatagatcaatcttttgtgtgtgtagtacgtaatttttgttctttttgcttttcgttcaagttgttgggaataatcggggtatcatgttttgatattgtttgttttcttttttgactgcttaataatttttaagttggttttggttttggggttttatgtgcttgttatattcaaatctttgtgatccagatcttacaaaagttttgggtttaaggatgtttttggctgatgatgaatagatctataaactgttccttttaatcgattcaagcttaggattttactaggcttttgcgaataaatacgtgacagtaagctaattatgtcctttttttgtctcaatcatatctgtctgggtgtgccataatttgtgatatgtctatctggtagaatcttgtgttttatgctttacgatttggtatacctgtttttgaacttgttgtatgatgggtatttagatcaccctatcttttttatgcttctggaagttttatgtaaatgtcgaatatcttaatgttgttgaacttataatgttgtgttgatgtatgtatgatggttttgacaacttttttcactggttctgaaagttttatgtaaattgcaaatatgttaatgttgttgaacttattttttttccttcgatgttgttttgatgtatgtatgatggttttcaccgtagtttctatggctaatatcttaatgttgttgagcttatttttttccttatatgttgtgttgatgtattgtatgatggttttgacaacttttttagtttctttgcagatttaaggaagatggataagaagtattctattggacttgatattggaaccaactctgtgggatgggctgttattactgacgagtataaggttccatctaagaagttcaaggttcttggaaacactgatagacactctattaagaagaaccttattggtgctcttcttttcgattctggagagactgctgaggctactagacttaagagaactgctagaagaagatatactagaagaaagaacagaatttgctatcttcaagagattttctctaacgagatggctaaggttgacgattctttcttccacagacttgaggagtctttccttgttgaggaggataagaagcacgagagacacccaattttcggaaacattgttgacgaggttgcttatcacgagaagtatccaactatttatcaccttagaaagaagctcgttgattctactgataaggctgatcttagacttatttatcttgctcttgctcacatgattaagttcagaggacacttccttattgagggagatcttaacccagataactctgacgttgataagctcttcattcaacttgttcaaacttataaccaacttttcgaggagaacccaattaacgcttctggagttgacgctaaggctattctttctgctagactttctaagtctagaaggcttgagaaccttattgctcaacttccaggagagaagaagaacggacttttcggaaaccttattgctctttctcttggacttactccaaacttcaagtctaacttcgatcttgctgaggacgctaagctccaactttctaaggatacttacgacgatgatcttgataaccttcttgctcaaattggagatcaatacgctgatcttttccttgctgctaagaacctttctgacgctattcttctttctgatattcttagagttaacactgagattactaaggctccactttctgcttctatgattaagagatacgacgagcaccaccaagatcttactcttcttaaggctcttgttagacaacaacttccagagaagtataaggagattttcttcgatcaatctaagaacggatacgctggatatattgacggaggagcttctcaagaggagttctataagttcattaagccaattcttgagaagatggacggaactgaggagcttcttgttaagctcaacagagaggatcttcttagaaagcaaagaactttcgataacggatctattccacaccaaattcaccttggagagcttcacgctattcttagaaggcaagaggatttctatccattccttaaggataacagagagaagattgagaagattcttactttccgtattccatattacgttggaccacttgctagaggaaactctagattcgcttggatgactagaaagtctgaggagactattactccttggaacttcgaggaggttgttgataagggagcttctgctcaatctttcattgagagaatgactaacttcgataagaaccttccaaacgagaaggttcttccaaagcactctcttctttacgagtatttcactgtttataacgagcttactaaggttaagtacgttactgagggaatgagaaagccagctttcctttctggagagcaaaagaaggctattgttgatcttcttttcaagactaacagaaaggttactgttaagcaacttaaggaggattatttcaagaagattgagtgcttcgattctgttgagatttctggagttgaggatagattcaacgcttctcttggaacttatcacgatcttcttaagattattaaggataaggatttccttgataacgaggagaacgaggatattcttgaggatattgttcttactcttactcttttcgaggatagagagatgattgaggagagacttaagacttacgctcaccttttcgacgataaggttatgaagcaacttaagagaagaagatatactggatggggtagactttctagaaagctcattaacggaattagagataagcaatctggaaagactattcttgatttccttaagtctgacggattcgctaacagaaacttcatgcaacttattcacgacgattctcttactttcaaggaggatattcaaaaggctcaagtttctggacaaggagattctcttcacgagcacattgctaaccttgctggatctccagctattaagaagggaattcttcaaactgttaaggttgttgacgagcttgttaaggttatgggtagacacaagccagagaacattgttattgagatggctagagagaaccaaactactcaaaagggacaaaagaactctagagagagaatgaagagaattgaggagggaattaaggagcttggatctcaaattcttaaggagcacccagttgagaacactcaacttcaaaacgagaagctctatctttattatcttcaaaacggaagagatatgtacgttgatcaagagcttgatattaacagactttctgattacgacgttgatcacattgttccacaatctttccttaaggacgattctattgataacaaggttcttactagatctgataagaacagaggaaagtctgataacgttccatctgaggaggttgttaagaagatgaagaactattggagacaacttcttaacgctaagctcattactcaaagaaagttcgataaccttactaaggctgagagaggaggactttctgagcttgataaggctggattcattaagagacaacttgttgagactagacaaattactaagcacgttgctcaaattcttgattctagaatgaacactaagtacgacgagaacgataagctcattagagaggttaaggttattactcttaagtctaagctcgtttctgatttcagaaaggatttccaattctataaggttagagagattaacaactatcaccacgctcacgacgcttatcttaacgctgttgttggaactgctcttattaagaagtatccaaaacttgagtctgagttcgtttacggagattataaggtttacgacgttagaaagatgattgctaagtctgagcaagagattggaaaggctactgctaagtatttcttctattctaacattatgaacttcttcaagactgagattactcttgctaacggagagattagaaagaggccacttattgagactaacggagagactggagagattgtttgggataagggaagagatttcgctactgttagaaaggttctttctatgccacaagttaacattgttaagaaaactgaggttcaaactggaggattctctaaggagtctattcttccaaagagaaactctgataagctcattgctagaaagaaggattgggacccaaagaagtacggaggattcgattctccaactgttgcttattctgttcttgttgttgctaaggttgagaagggaaagtctaagaagctcaagtctgttaaggagcttgttggaattactattatggagagatcttctttcgagaagaacccagttgatttccttgaggctaagggatataaggaggttaagaaggatcttattattaagctcccaaagtattctcttttcgagcttgagaacggaagaaagagaatgcttgcttctgctggagagcttcaaaagggaaacgagcttgctcttccatctaagtacgttaacttcctttatcttgcttctcactacgagaagctcaagggatctccagaggataacgagcaaaagcaacttttcgttgagcaacacaagcactatcttgacgagattattgagcaaatttctgagttctctaagagagttattcttgctgacgctaaccttgataaggttctttctgcttataacaagcacagagataagccaattagagagcaagctgagaacattattcaccttttcactcttactaaccttggtgctccagctgctttcaagtatttcgatactactattgatagaaagagatatacttctactaaggaggttcttgacgctactcttattcaccaatctattactggactttacgagactagaattgatctttctcaacttggaggagattcttctccaccaaagaagaagagaaaggtttcttggaaggacgcttctggatggtctagaatgtgagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaagcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgataccggatttgcgagaagcgttttagagctagaaatagcaagttaaaataaggctagtccgttatcaacttgaaaaagtggcaccgagtcggtgctttttttttaactaattaaagaaaataaaaatgcaagtgcggtgacaagacaagctagaataaagttgcaaagaaatgacagggctacaaaaggctcacctacttctggatttaccaaacttctgtttgtccccatactccaaaaacaaaaccatttttttttatcttcgtttttgtttgctttgactgtgagttgaggcccaactttctgcttctgtccgactctatttgatgaattttgtttgcctcctgtgatgtgaaggatgtatcattgaaagggaacgtgtctcaatgatcccacatcggccaaatatgctcattacattgcgtttatatagtcccaggaaaacatatggattggaaggaagaagaggcgcaatgttttagagctagaaatagcaagttaaaataaggctagtccgttatcaacttgaaaaagtggcaccgagtcggtgctttttttttaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagaattcaagcttgatatcggaagtttctctcttgagggaggttgctcgtggaatgggacacatatggttgttataataaaccatttccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatgtctactgtttttattgattcaatatttgattgttcttttttttgcagatttgttgaccagatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccgtccagcaactgctcgtaagtcctctggtctttctggaaccgtccgtattccaggtgacaagtctatctcccacaggtccttcatgtttggaggtctcgctagcggtgaaactcgtatcaccggtcttttggaaggtgaagatgttatcaacactggtaaggctatgcaagctatgggtgccagaatccgtaaggaaggtgatacttggatcattgatggtgttggtaacggtggactccttgctcctgaggctcctctcgatttcggtaacgctgcaactggttgccgtttgactatgggtcttgttggtgtttacgatttcgatagcactttcattggtgacgcttctctcactaagcgtccaatgggtcgtgtgttgaacccacttcgcgaaatgggtgtgcaggtgaagtctgaagacggtgatcgtcttccagttaccttgcgtggaccaaagactccaacgccaatcacctacagggtacctatggcttccgctcaagtgaagtccgctgttctgcttgctggtctcaacaccccaggtatcaccactgttatcgagccaatcatgactcgtgaccacactgaaaagatgcttcaaggttttggtgctaaccttaccgttgagactgatgctgacggtgtgcgtaccatccgtcttgaaggtcgtggtaagctcaccggtcaagtgattgatgttccaggtgatccatcctctactgctttcccattggttgctgccttgcttgttccaggttccgacgtcaccatccttaacgttttgatgaacccaacccgtactggtctcatcttgactctgcaggaaatgggtgccgacatcgaagtgatcaacccacgtcttgctggtggagaagacgtggctgacttgcgtgttcgttcttctactttgaagggtgttactgttccagaagaccgtgctccttctatgatcgacgagtatccaattctcgctgttgcagctgcattcgctgaaggtgctaccgttatgaacggtttggaagaactccgtgttaaggaaagcgaccgtctttctgctgtcgcaaacggtctcaagctcaacggtgttgattgcgatgaaggtgagacttctctcgtcgtgcgtggtcgtcctgacggtaagggtctcggtaacgcttctggagcagctgtcgctacccacctcgatcaccgtatcgctatgagcttcctcgttatgggtctcgtttctgaaaaccctgttactgttgatgatgctactatgatcgctactagcttcccagagttcatggatttgatggctggtcttggagctaagatcgaactctccgacactaaggctgcttgaagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 517 - DNA, 13324 bp, Artificial sequence
  synthesized vector
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccgcctctactctagtctagagtcactgaatccctttgatcattaggataaagtcaacaagacttacaagagtcatggttttgatttgagctaaaataatttccatgtggcaagaaatttctttcatggagccttggaaagcaagaaatttcttcctaacgttgtttgaacactagcacggtcccatacacacatattaaaataattcattctctagaagcaagcagaaactcaaaattttaaatgattatttcgtgggaagtttgaaattttcacaagttcatgcgataagaaaacatttaattaaggtatttatctctaatgacagattcaagagggagacagcttgtcaaatgaacagttatttgatgcaagtctctttcattgcccgaattatttgtgatgatattgacagaaaatgcagaactttttttgggcatcatctattcatcttttggccaaaaaaattgtcaatctaattctgtggatcagtggatggtcttggaattaggcaagctagatagagacacgaattcagcttttcttgtgtgaaagttgatggaagttactaactcaaccaaatgctctttggatttccattgtcaaagccacagaaagagtgtgcttgattaaagcgtgagtttggttgatttattgaaaaaatactacacaaaattatttgttttatgttggttttagaaattattatacaaaaaaataaaatgaaaaaaatgaaaaaaatttaaatattcattactgctcaaattatggaacaaatttttatctcatgagtcatcatgaaacaattttttatctcatgaagtgcatatgctggagttggttcccgtgggttgttgtattttgcttaatatggattgttccctggactagttcatttgtagtttttgtttgtttggggccttgggccattcttatcactaaaacacacacatgcacgcttaccaacaactcatttgatttcttatgacaattttttttctaatcacgataataataccaaatattcataatcaaaaaagttaagattcaaaccttatattatttagttaagaaatataggtctttatcatttgtgttaatcggttattattttttttctttcatttaattttaaaatattcatctccttaaaaaaattccaatgaccctaaaggagggttagtatacaactaaaactaaccaagtccctttttttaaaaaaaaatacattaattaaatatctctatctcagaggctgtttgattgagtcaaaagagaataaaaaataagtaaaataaacagtaaaattttataaaatccatatttttattctcaatttaaattttcatttatttttacctttatttttttttccactctaccaaacatgtacttagatttgaccataaaagaactcgagcaaacagaaattcgaccattcacttcatttactcattgactagtttctcaccgtcgatgataaatcatcaacgctccccgtgatcccctccaccgttacaaacttgtgcccctacctacactaaccccaaatgcaattcaacttttaaaaggcgccaacactttaactgaatcagtttgttcagttaaagcgctctctctctctctctgttcttcctcttcgcacgaaaacacgatgcgacagagatcgtaatcgaagccaaaaccaattttccataatcataatcaacactgtctttcgctctcatcgaagcctgcaagaagcgtaaacggttgccgaagtttttcaggttcaactcgttcggcgaccctggtgttgttccaattgcacgttcgggtcccttccgcgataacgttcgcgttttccttcaagaagctggcgatctcgaagactacactgtctccgggaaccccctctggtgcattcttctcatccacgacaactcgtacgctctggctcctctttacaccatcgaagaacacgtcgaccactcttcgcaccccttctgcgatcactgccgctgcgtaggttcgtttccgaatttcgccttcttgggtttggtttgattgttgattcttgaaatggggttgcttcaagtttgggttttttgcttgatttttgaaatgggtctgaataatgtgattgcgttttgttgcttgtttctgaaaaggttttttttttacgtgttttgtggttttattttcgtcctgattgagttaatctgtttcgggtattttgatacgggtgatgatgtgggctgtttccaattttggatttttttctatagtagggtattgttgagaagggttgcttagtggtttgggttgtttgagaaaatgtgtattttaatttttgtttatcattttgaattacaaaacggatacttttttttatttaagttatggtttttgaagagtttgaaaaggaaaaatacttttcattgatttctgattatagactatagagacttttgaaaatagaaagaatgagaaaaaatgtgacatttttgtgattggaaatgaaaacagaagcattttcttctgacaagttttccaaaaatggctgtggagtatagtatagggactagggttatcattgatactgataatgataccaatatgcggctttgtttggttaaaagtttgtaaaggaaaaaacacttcccattgatcatattattgtttggtatacagacttttgaaaatagaaacagtgaatacatgaattctatgattagaaatgaaaacagaaacatttttttatgactagtattccaaaaatgttgatttattatgaaaagggttggtaggaagtttgatgattttgaattttggataatgggttttagaactactgatgtcgatattaatatttgactttgtttggtcaataattgataggttggagtggacattatggataagaagtattctattggacttgatattggaaccaactctgtgggatgggctgttattactgacgagtataaggttccatctaagaagttcaaggttcttggaaacactgatagacactctattaagaagaaccttattggtgctcttcttttcgattctggagagactgctgaggctactagacttaagagaactgctagaagaagatatactagaagaaagaacagaatttgctatcttcaagagattttctctaacgagatggctaaggttgacgattctttcttccacagacttgaggagtctttccttgttgaggaggataagaagcacgagagacacccaattttcggaaacattgttgacgaggttgcttatcacgagaagtatccaactatttatcaccttagaaagaagctcgttgattctactgataaggctgatcttagacttatttatcttgctcttgctcacatgattaagttcagaggacacttccttattgagggagatcttaacccagataactctgacgttgataagctcttcattcaacttgttcaaacttataaccaacttttcgaggagaacccaattaacgcttctggagttgacgctaaggctattctttctgctagactttctaagtctagaaggcttgagaaccttattgctcaacttccaggagagaagaagaacggacttttcggaaaccttattgctctttctcttggacttactccaaacttcaagtctaacttcgatcttgctgaggacgctaagctccaactttctaaggatacttacgacgatgatcttgataaccttcttgctcaaattggagatcaatacgctgatcttttccttgctgctaagaacctttctgacgctattcttctttctgatattcttagagttaacactgagattactaaggctccactttctgcttctatgattaagagatacgacgagcaccaccaagatcttactcttcttaaggctcttgttagacaacaacttccagagaagtataaggagattttcttcgatcaatctaagaacggatacgctggatatattgacggaggagcttctcaagaggagttctataagttcattaagccaattcttgagaagatggacggaactgaggagcttcttgttaagctcaacagagaggatcttcttagaaagcaaagaactttcgataacggatctattccacaccaaattcaccttggagagcttcacgctattcttagaaggcaagaggatttctatccattccttaaggataacagagagaagattgagaagattcttactttccgtattccatattacgttggaccacttgctagaggaaactctagattcgcttggatgactagaaagtctgaggagactattactccttggaacttcgaggaggttgttgataagggagcttctgctcaatctttcattgagagaatgactaacttcgataagaaccttccaaacgagaaggttcttccaaagcactctcttctttacgagtatttcactgtttataacgagcttactaaggttaagtacgttactgagggaatgagaaagccagctttcctttctggagagcaaaagaaggctattgttgatcttcttttcaagactaacagaaaggttactgttaagcaacttaaggaggattatttcaagaagattgagtgcttcgattctgttgagatttctggagttgaggatagattcaacgcttctcttggaacttatcacgatcttcttaagattattaaggataaggatttccttgataacgaggagaacgaggatattcttgaggatattgttcttactcttactcttttcgaggatagagagatgattgaggagagacttaagacttacgctcaccttttcgacgataaggttatgaagcaacttaagagaagaagatatactggatggggtagactttctagaaagctcattaacggaattagagataagcaatctggaaagactattcttgatttccttaagtctgacggattcgctaacagaaacttcatgcaacttattcacgacgattctcttactttcaaggaggatattcaaaaggctcaagtttctggacaaggagattctcttcacgagcacattgctaaccttgctggatctccagctattaagaagggaattcttcaaactgttaaggttgttgacgagcttgttaaggttatgggtagacacaagccagagaacattgttattgagatggctagagagaaccaaactactcaaaagggacaaaagaactctagagagagaatgaagagaattgaggagggaattaaggagcttggatctcaaattcttaaggagcacccagttgagaacactcaacttcaaaacgagaagctctatctttattatcttcaaaacggaagagatatgtacgttgatcaagagcttgatattaacagactttctgattacgacgttgatcacattgttccacaatctttccttaaggacgattctattgataacaaggttcttactagatctgataagaacagaggaaagtctgataacgttccatctgaggaggttgttaagaagatgaagaactattggagacaacttcttaacgctaagctcattactcaaagaaagttcgataaccttactaaggctgagagaggaggactttctgagcttgataaggctggattcattaagagacaacttgttgagactagacaaattactaagcacgttgctcaaattcttgattctagaatgaacactaagtacgacgagaacgataagctcattagagaggttaaggttattactcttaagtctaagctcgtttctgatttcagaaaggatttccaattctataaggttagagagattaacaactatcaccacgctcacgacgcttatcttaacgctgttgttggaactgctcttattaagaagtatccaaaacttgagtctgagttcgtttacggagattataaggtttacgacgttagaaagatgattgctaagtctgagcaagagattggaaaggctactgctaagtatttcttctattctaacattatgaacttcttcaagactgagattactcttgctaacggagagattagaaagaggccacttattgagactaacggagagactggagagattgtttgggataagggaagagatttcgctactgttagaaaggttctttctatgccacaagttaacattgttaagaaaactgaggttcaaactggaggattctctaaggagtctattcttccaaagagaaactctgataagctcattgctagaaagaaggattgggacccaaagaagtacggaggattcgattctccaactgttgcttattctgttcttgttgttgctaaggttgagaagggaaagtctaagaagctcaagtctgttaaggagcttgttggaattactattatggagagatcttctttcgagaagaacccagttgatttccttgaggctaagggatataaggaggttaagaaggatcttattattaagctcccaaagtattctcttttcgagcttgagaacggaagaaagagaatgcttgcttctgctggagagcttcaaaagggaaacgagcttgctcttccatctaagtacgttaacttcctttatcttgcttctcactacgagaagctcaagggatctccagaggataacgagcaaaagcaacttttcgttgagcaacacaagcactatcttgacgagattattgagcaaatttctgagttctctaagagagttattcttgctgacgctaaccttgataaggttctttctgcttataacaagcacagagataagccaattagagagcaagctgagaacattattcaccttttcactcttactaaccttggtgctccagctgctttcaagtatttcgatactactattgatagaaagagatatacttctactaaggaggttcttgacgctactcttattcaccaatctattactggactttacgagactagaattgatctttctcaacttggaggagattcttctccaccaaagaagaagagaaaggtttcttggaaggacgcttctggatggtctagaatgtgaaatgcttgaatactgcgttgtaagatcaatacatacttgtttctgtttgttcttatttcatttgttgattcttttaatattttttcacacctcttttttttgaagtgaggtgtgttaacgtcccttttgagacgttggttttttgttggtgatttgaaagaacagttcccccttttttttttttttgatactttcaattcagtgaaggaaaaacaataagtggaaggaatagtacttcgtcgttggtgttataaagtttggtatagacacatctcacatatgtattaagtattcgatattatagtggattttgataatggatttgttaataatatactgatatcaattctcataaaaaaatattttatttttatttttttgaattctcgaaattattaattattattgtaaaaaagttacaatgaaaataaacatctgatagatgataatggatccagtttagttacccttactccatttccctctaattgtgatgaataaagcacgtatttgcaaaacgatacatagtgcatatcacgtttattgatgagtaaaataattggttatcatcagcttgcattttactacataacataacttatacgtcaacagcagtgttaaaatagttttacacaaagtggtgtatgactagatctagaaaatatttattggataaaatttatttaaatttataaaaaatttattctcatttttatttaatgaatatcaattattgtttagtaatttttaataattttaattaactagtgtttaatgcacgggcttactcatttttttttactactttgtttatatagccaataaatttttttttaaaaaaagataataatatatctcaagaaattagaaactataaaatttgaagaaaaaaaaggggactatatagcacatcgaatttatttttggaaaaaagagataagctatctccaacaaattaaagactataatttttttaaaaaaaataagaaaaaatgaataaaagcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgataccggatttgcgagaagcgttttagagctagaaatagcaagttaaaataaggctagtccgttatcaacttgaaaaagtggcaccgagtcggtgctttttttttaactaattaaagaaaataaaaatgcaagtgcggtgacaagacaagctagaataaagttgcaaagaaatgacagggctacaaaaggctcacctacttctggatttaccaaacttctgtttgtccccatactccaaaaacaaaaccatttttttttatcttcgtttttgtttgctttgactgtgagttgaggcccaactttctgcttctgtccgactctatttgatgaattttgtttgcctcctgtgatgtgaaggatgtatcattgaaagggaacgtgtctcaatgatcccacatcggccaaatatgctcattacattgcgtttatatagtcccaggaaaacatatggattggaaggaagaagaggcgcaatgttttagagctagaaatagcaagttaaaataaggctagtccgttatcaacttgaaaaagtggcaccgagtcggtgctttttttttaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagaattcaagcttgatatcggaagtttctctcttgagggaggttgctcgtggaatgggacacatatggttgttataataaaccatttccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatgtctactgtttttattgattcaatatttgattgttcttttttttgcagatttgttgaccagatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccgtccagcaactgctcgtaagtcctctggtctttctggaaccgtccgtattccaggtgacaagtctatctcccacaggtccttcatgtttggaggtctcgctagcggtgaaactcgtatcaccggtcttttggaaggtgaagatgttatcaacactggtaaggctatgcaagctatgggtgccagaatccgtaaggaaggtgatacttggatcattgatggtgttggtaacggtggactccttgctcctgaggctcctctcgatttcggtaacgctgcaactggttgccgtttgactatgggtcttgttggtgtttacgatttcgatagcactttcattggtgacgcttctctcactaagcgtccaatgggtcgtgtgttgaacccacttcgcgaaatgggtgtgcaggtgaagtctgaagacggtgatcgtcttccagttaccttgcgtggaccaaagactccaacgccaatcacctacagggtacctatggcttccgctcaagtgaagtccgctgttctgcttgctggtctcaacaccccaggtatcaccactgttatcgagccaatcatgactcgtgaccacactgaaaagatgcttcaaggttttggtgctaaccttaccgttgagactgatgctgacggtgtgcgtaccatccgtcttgaaggtcgtggtaagctcaccggtcaagtgattgatgttccaggtgatccatcctctactgctttcccattggttgctgccttgcttgttccaggttccgacgtcaccatccttaacgttttgatgaacccaacccgtactggtctcatcttgactctgcaggaaatgggtgccgacatcgaagtgatcaacccacgtcttgctggtggagaagacgtggctgacttgcgtgttcgttcttctactttgaagggtgttactgttccagaagaccgtgctccttctatgatcgacgagtatccaattctcgctgttgcagctgcattcgctgaaggtgctaccgttatgaacggtttggaagaactccgtgttaaggaaagcgaccgtctttctgctgtcgcaaacggtctcaagctcaacggtgttgattgcgatgaaggtgagacttctctcgtcgtgcgtggtcgtcctgacggtaagggtctcggtaacgcttctggagcagctgtcgctacccacctcgatcaccgtatcgctatgagcttcctcgttatgggtctcgtttctgaaaaccctgttactgttgatgatgctactatgatcgctactagcttcccagagttcatggatttgatggctggtcttggagctaagatcgaactctccgacactaaggctgcttgaagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 518 - DNA, 2893 bp, Glycine max derived;
gcctctactctagtctagagtcactgaatccctttgatcattaggataaagtcaacaagacttacaagagtcatggttttgatttgagctaaaataatttccatgtggcaagaaatttctttcatggagccttggaaagcaagaaatttcttcctaacgttgtttgaacactagcacggtcccatacacacatattaaaataattcattctctagaagcaagcagaaactcaaaattttaaatgattatttcgtgggaagtttgaaattttcacaagttcatgcgataagaaaacatttaattaaggtatttatctctaatgacagattcaagagggagacagcttgtcaaatgaacagttatttgatgcaagtctctttcattgcccgaattatttgtgatgatattgacagaaaatgcagaactttttttgggcatcatctattcatcttttggccaaaaaaattgtcaatctaattctgtggatcagtggatggtcttggaattaggcaagctagatagagacacgaattcagcttttcttgtgtgaaagttgatggaagttactaactcaaccaaatgctctttggatttccattgtcaaagccacagaaagagtgtgcttgattaaagcgtgagtttggttgatttattgaaaaaatactacacaaaattatttgttttatgttggttttagaaattattatacaaaaaaataaaatgaaaaaaatgaaaaaaatttaaatattcattactgctcaaattatggaacaaatttttatctcatgagtcatcatgaaacaattttttatctcatgaagtgcatatgctggagttggttcccgtgggttgttgtattttgcttaatatggattgttccctggactagttcatttgtagtttttgtttgtttggggccttgggccattcttatcactaaaacacacacatgcacgcttaccaacaactcatttgatttcttatgacaattttttttctaatcacgataataataccaaatattcataatcaaaaaagttaagattcaaaccttatattatttagttaagaaatataggtctttatcatttgtgttaatcggttattattttttttctttcatttaattttaaaatattcatctccttaaaaaaattccaatgaccctaaaggagggttagtatacaactaaaactaaccaagtccctttttttaaaaaaaaatacattaattaaatatctctatctcagaggctgtttgattgagtcaaaagagaataaaaaataagtaaaataaacagtaaaattttataaaatccatatttttattctcaatttaaattttcatttatttttacctttatttttttttccactctaccaaacatgtacttagatttgaccataaaagaactcgagcaaacagaaattcgaccattcacttcatttactcattgactagtttctcaccgtcgatgataaatcatcaacgctccccgtgatcccctccaccgttacaaacttgtgcccctacctacactaaccccaaatgcaattcaacttttaaaaggcgccaacactttaactgaatcagtttgttcagttaaagcgctctctctctctctctgttcttcctcttcgcacgaaaacacgatgcgacagagatcgtaatcgaagccaaaaccaattttccataatcataatcaacactgtctttcgctctcatcgaagcctgcaagaagcgtaaacggttgccgaagtttttcaggttcaactcgttcggcgaccctggtgttgttccaattgcacgttcgggtcccttccgcgataacgttcgcgttttccttcaagaagctggcgatctcgaagactacactgtctccgggaaccccctctggtgcattcttctcatccacgacaactcgtacgctctggctcctctttacaccatcgaagaacacgtcgaccactcttcgcaccccttctgcgatcactgccgctgcgtaggttcgtttccgaatttcgccttcttgggtttggtttgattgttgattcttgaaatggggttgcttcaagtttgggttttttgcttgatttttgaaatgggtctgaataatgtgattgcgttttgttgcttgtttctgaaaaggttttttttttacgtgttttgtggttttattttcgtcctgattgagttaatctgtttcgggtattttgatacgggtgatgatgtgggctgtttccaattttggatttttttctatagtagggtattgttgagaagggttgcttagtggtttgggttgtttgagaaaatgtgtattttaatttttgtttatcattttgaattacaaaacggatacttttttttatttaagttatggtttttgaagagtttgaaaaggaaaaatacttttcattgatttctgattatagactatagagacttttgaaaatagaaagaatgagaaaaaatgtgacatttttgtgattggaaatgaaaacagaagcattttcttctgacaagttttccaaaaatggctgtggagtatagtatagggactagggttatcattgatactgataatgataccaatatgcggctttgtttggttaaaagtttgtaaaggaaaaaacacttcccattgatcatattattgtttggtatacagacttttgaaaatagaaacagtgaatacatgaattctatgattagaaatgaaaacagaaacatttttttatgactagtattccaaaaatgttgatttattatgaaaagggttggtaggaagtttgatgattttgaattttggataatgggttttagaactactgatgtcgatattaatatttgactttgtttggtcaataattgataggttggagtggacatt

SEQ ID NO: 519 - DNA, 1000 bp, Glycine max derived;
aatgcttgaatactgcgttgtaagatcaatacatacttgtttctgtttgttcttatttcatttgttgattcttttaatattttttcacacctcttttttttgaagtgaggtgtgttaacgtcccttttgagacgttggttttttgttggtgatttgaaagaacagttcccccttttttttttttttgatactttcaattcagtgaaggaaaaacaataagtggaaggaatagtacttcgtcgttggtgttataaagtttggtatagacacatctcacatatgtattaagtattcgatattatagtggattttgataatggatttgttaataatatactgatatcaattctcataaaaaaatattttatttttatttttttgaattctcgaaattattaattattattgtaaaaaagttacaatgaaaataaacatctgatagatgataatggatccagtttagttacccttactccatttccctctaattgtgatgaataaagcacgtatttgcaaaacgatacatagtgcatatcacgtttattgatgagtaaaataattggttatcatcagcttgcattttactacataacataacttatacgtcaacagcagtgttaaaatagttttacacaaagtggtgtatgactagatctagaaaatatttattggataaaatttatttaaatttataaaaaatttattctcatttttatttaatgaatatcaattattgtttagtaatttttaataattttaattaactagtgtttaatgcacgggcttactcatttttttttactactttgtttatatagccaataaatttttttttaaaaaaagataataatatatctcaagaaattagaaactataaaatttgaagaaaaaaaaggggactatatagcacatcgaatttatttttggaaaaaagagataagctatctccaacaaattaaagactataatttttttaaaaaaaataagaaaaaatgaataa

SEQ ID NO: 520 - DNA, 20 bp, Artificial sequence
  synthesized vector component
ataccggatttgcgagaagc

SEQ ID NO: 521 - DNA, 20 bp, Artificial sequence
  synthesized vector component
gaaggaagaagaggcgcaat

SEQ ID NO: 522 - DNA, 20 bp, Artificial sequence
  synthesized vector component
aacggtgttgattgcgatga

SEQ ID NO: 523 - DNA, 20 bp, Artificial sequence
  synthesized vector component
gctgctccagaagcgttacc

SEQ ID NO: 524 - DNA, 25 bp, Artificial sequence
  synthesized vector component
acttctctcgtcgtgcgtggtcgtc

SEQ ID NO: 525 - DNA, 25 bp, Artificial sequence
  synthesized vector component
caagtttctggacaaggagattctc

SEQ ID NO: 526 - DNA, 27 bp, Artificial sequence
  synthesized vector component
aagaattcccttcttaatagctggaga

SEQ ID NO: 527 - DNA, 26 bp, Artificial sequence
  synthesized vector component
cacgagcacattgctaaccttgctgg

SEQ ID NO: 528 - DNA, 19 bp, Artificial sequence
  synthesized vector component
ttgtgctgctccacgaaca

SEQ ID NO: 529 - DNA, 20 bp, Artificial sequence
  synthesized vector component
gccagccactacgagaagct

SEQ ID NO: 530 - DNA, 24 bp, Artificial sequence
  synthesized vector component
ctgcttctgctcgttgtcctccgg

SEQ ID NO: 531 - DNA, 1010 bp, Artificial sequence
  synthesized vector component
gtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 532 - DNA, 3783 bp, Artificial sequence
  synthesized vector component
atggctcctaagaagaagcggaaggttggtattcacggggtgcctgcggcttcaaagctcgagaaattcaccaactgttattcgttgagcaaaacactgcggtttaaagcgattccagtcggcaagactcaagagaatatagacaataagcggctgttggtggaagatgaaaagcgcgcggaagactacaaaggggtgaagaagttgttggacagatactacctctcttttatcaatgatgtcttgcactcaatcaaattgaagaatctgaacaactacatctccctcttcagaaagaaaacaaggacagaaaaggagaataaggaacttgaaaatttggagatcaatctgaggaaagagatcgcgaaagcctttaaaggcaacgaaggatacaaaagtctgttcaagaaggatataattgagacaattttgccagagttcctcgatgacaaggacgagattgcgctggtcaattcgttcaacggattcacaacagcattcacaggcttctttgataatcgggaaaatatgttctctgaggaggcaaagtccacttctattgcgttcaggtgtatcaatgagaatctcactaggtacatttccaacatggatatctttgagaaggttgacgcaatttttgacaagcacgaagttcaggagattaaggagaagatcctcaattccgattatgacgttgaggacttcttcgagggtgagttttttaatttcgtgctcactcaagagggtatcgacgtgtataatgcgatcatcggtgggttcgtgactgagtccggtgaaaagattaagggattgaacgagtatatcaacctttacaaccaaaagacgaaacagaagctgccaaagttcaagcctctttacaaacaggttctttcagaccgcgagtcactctcgttctatggggagggctacacttcggatgaggaagtcctggaggtgttcaggaatactctcaataagaattcggagattttctcttctataaaaaaactggaaaagttgtttaagaattttgacgaatactctagcgccggcatatttgtgaaaaacggcccggccatatcaacgataagtaaagatatcttcggcgaatggaacgtgatcagagacaaatggaacgcggagtatgacgatattcacctgaagaagaaggctgtcgtaacggagaagtacgaggatgatcgcaggaaaagcttcaaaaagatcggaagtttcagcctggaacagttgcaggagtatgctgacgccgatcttagcgtcgtcgagaagttgaaggagataatcatccaaaaggtcgacgagatatataaagtctatggatcaagtgaaaaactgttcgacgccgacttcgttttggagaagtccctgaagaagaacgacgctgttgttgccattatgaaggatctgctcgacagcgtgaagagtttcgagaactatattaaggcttttttcggggaggggaaggagactaacagagatgagtccttctacggagacttcgtcctcgcgtacgatatactccttaaggtagaccacatctacgacgcaatcagaaattacgtgacacaaaagccgtacagcaaggacaagttcaaactctacttccagaacccccagttcatgggcggctgggacaaggacaaggaaacggattacagggctacgatcctgaggtatggttcaaaatactacttggcgattatggacaagaagtacgccaagtgtctccagaagattgacaaagacgatgtcaatggcaattatgagaagatcaactacaagctgcttccgggtccgaacaagatgctcccaaaggttttcttcagcaagaaatggatggcctactataacccaagcgaggacatccagaagatttataagaacggtacgttcaagaagggcgacatgttcaatcttaacgactgtcacaagctgatcgacttcttcaaagactcaattagccggtacccaaagtggtctaacgcctatgacttcaacttttcggaaaccgagaagtacaaggatatagccggattttatagagaggtggaagagcagggctacaaggtgtcattcgagtccgccagcaagaaggaagtggacaagctcgtggaagagggtaagctctacatgttccagatttataataaagactttagcgataagagccacgggacacctaatctccacacaatgtatttcaagctgctcttcgacgagaataaccacggccaaatcaggttgtcaggaggggctgaactcttcatgcggcgcgctagccttaagaaggaggagcttgtagtccaccctgcgaatagtccaattgcgaataagaacccggacaatcctaaaaagactacaacattgagctacgacgtgtacaaggataagaggttttccgaggatcagtacgagctccacatcccgattgcgatcaacaagtgcccaaagaatattttcaagataaacacagaggtgcgtgtactcctgaagcatgacgacaatccttacgtcattgggattgatcggggcgagaggaacctcctctatattgtggtggtggacgggaaggggaacatagtcgaacagtactcccttaacgaaataattaacaatttcaacggcatccgtatcaagaccgactaccattcgttgctggacaagaaggagaaggagagatttgaggcgcggcaaaattggacaagtatcgagaacatcaaggaactcaaagcaggttatatctctcaagttgtgcataagatatgcgagctggttgagaagtatgacgcagtgatcgctcttgaggacctcaactcgggctttaagaattctagagttaaagtggagaagcaggtctatcaaaagttcgagaagatgcttatagataagctcaactacatggtcgataagaaatcgaacccatgtgccaccggcggcgcactcaaaggttaccaaataacaaacaaattcgagtccttcaaatcgatgagtactcagaatgggttcatattttatataccggcgtggcttacgtctaagatcgacccgtcaactggttttgtcaacctgttgaagacgaaatacacgtccattgccgattcaaaaaagttcatatctagttttgatcgtattatgtacgtcccagaggaagatcttttcgagtttgctctcgactacaaaaacttttcgcgcaccgatgcggattacattaaaaaatggaaactctattcgtacggcaacagaatcaggatttttcgcaaccctaagaagaataacgtctttgattgggaggaagtttgcttgactagcgcgtacaaggagctctttaataagtatggcattaactaccaacagggtgatatcagagcactgctttgcgaacaatctgacaaggctttctactcatccttcatggctttgatgagcctgatgctccagatgagaaattcaattacaggcagaaccgacgtggatttcttgatctccccggttaaaaattctgatggcatcttttacgatagcaggaactatgaagcgcaagagaatgcgattctgccaaaaaatgcagacgccaacggtgcctataacatcgccaggaaagtcctgtgggcgatcggccagttcaaaaaggccgaagacgaaaaattggacaaggtcaaaatcgctatcagcaacaaagagtggctggagtatgctcagacatccgtaaagcataagcgtcctgctgccaccaaaaaggccggacaggctaagaaaaagaagtga

SEQ ID NO: 533 - DNA, 21364 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttatagccgtttctttgttttttttcttctgttgagctccaactttatgaaacgtcgtaagctggtaattatgaaatgtaaggatttggagagagaaaaaaaacgggagggaaaaccatgcatgctgctgacgcgacggccggacgcagacgcaacaatgcccccggtgcggcgttgtcgagcagccactgcaccaccccacgcatcacctgcagtaatctagcgacgggtttttcttatttatttatttatttatttatttttcttctctccctccctccctcagatttgttttcgttttcattaatcgttattaccagcaattaattaactttatctattgatttaccaaaccgcaataaagaatatatatattcttttattaaggtccagtaataagcagcacagaagcgcaggtgcagcagcagcagcgtcagcgcccgaggcgcgcacgagagaaacagaggctgacgaggtggggcccgtgcgggccttgaccaatcggagttcgacaacagcctggccacccacaaacacacactccttcgcctcgcgccggccgtcgtcgcctccctccaccgaacgatccctcctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgaaggggcgcggcaaggtacagctgaagcggatagagaacaagataaaccggcaggtgaccttctccaagcgccggaacggcctgctcaagaaggcgcacgagatctccgtcctctgcgttgccgaggtcgccgtcatcgtcttctcccccaagggcaagctctacgagtacgccaccgactcccggtacgtacgaccaccttcaattcgtcacacaggcagtgtgtttgttgaattgaatacgtgcctgctatgctagctgcctgtcagtatggtccatccgttcgccatcagttcatctttctgcttcgtgctgctgttgtgtgtgtgcgccataccatgccatgccatgccatgccaccaacctggctgtgctgccgtttttggctcgcagccgccgatccccgacccgaaagctcatgctgctcttgccgttttcggccaccacccaccatggcctgctgtctggtcctccacgcctgcttccccagttccacttccatgcatggtggtcagttggctggcatggcagcagcagccgccttctggttcgtttgtgctgcctcaggatttgctttctactagctagtgtgctacagccgatcatttcatgctgctgcccgcgtcgatctgctccgctagctgcttcctcgtttcgggaaacctcgcccgccccgccattaactgattcacctgctttccttctgttgcggtgttgcctacgacgactgaaacctttcctttttggggattggcgtctgccgactccactaggcctccttttaattccttgttttatatacatgtacataagcttttgctgatgcagtggtacggtgcctttatttttatcggattacagtacgtgttagattgataacagcacgcaatcagatctagctttgcttgcttccttccttcctcgtcaaatctttctggcccttctcgatttgcgctccatcgtataattaattaaccatcactaatcacactttccccatttttctaaacaaaaaaaagtatcacatgttcctaatcacgcgtgcatgtaatttgctgtttctttctctctctctctcaattaatttgctgcctgccgagaaacacgagctgcatgctggctcaatcagttcctaactgcgaaagtgcagataatgaccccctcggctcggattaatcagtacacatgatcgaggacgcatagatctggcttttccttatctggttcttcgtcttcaattctccgtttcttccctcgcatccttttccgtgttgtttcagatttacaaataaaccatcgtctgtctcactttcatctgttgttcttccatgacagtgaaaaatactgttttttcctcgggtgcatggaaaaattaaaattaaaggcccgtgtttttttctctttggatgtgttcttataggatggatacactatgtgcatccgggttttgtggtgatgtaacatagtaaagcagctccgaggtactgggttctatttcatattccccccccccccaaatcaaaaaagttatctttgctcgaaggtctactcgtttttttttctggcttttatacgaattctatgacatgctagtatgggtaaaaacgaaatggtgattctcattcgtatatgcactattatattctttgcatgcacttttattacaaaagctgcatggacgtgttacacattcacggagataacaattgagcagtagattagtttctgtcttcttaattagctaggcaggctcagaggtgaaactgcagctattaggttgagtaacacagctagtgctgtattcatgaagcttcggtttgactcagttttgcagtagcactggttgcaactcgctaaaccatttaacttccatgtacatgatgtctttgtaggagtttgtgttcattcttcttattttgacatttcaagtcattcagtacgtaactactaaaataagtgtcttgcagagtcagtctcaagataacttgttggtcttggcttattagctaagatgcaatgcatcattacttgccttactgtgatggctaaaccaatatcacatgcactgtgtgctttttcaagcattccacatccatacatacctagtatccctgactttttaatgacccctgatgatagaacatgcattgtttgtatattacctgttagtgttcttaacataaaattttacaaaagaagctctattacgaggatgttatgctgcttttgcaaaggaaactagctaggcagactggtgctttttaaataaacaattaaaatcttgtgaacccaaacactacttacagatcgaaaattacagtaagacgaaagtaaatggcaactagtacaatactcgtacatgcgttgcgacggcacataaaaacaaatattacgttttatcttagccaaagcgtctagaaaggtatgagttgaaaagaagactttttatagcttactcggtcgctgttcttcctttagctagcaagttaatactatatgggagcgctacgcagtgtgccgcttcctctcgtgttgggctcaggtggtttctcacagtccatctgtaaggtaacagcacactaataggagcttcagtgggcttatttatgagataacagcctactcattaatacacctacatgtgaaaggacgatcgtcgaaactggtgttttatagtagtagaaatgaactttgaggcatagcttctttgcaattccattgttagcttgtttttttgttttgaagatacatgtcgttagcttacttgttggattgcatgtaaacatgcatcatggttgctttagaaaattttgttgacgttgatgagtacatttctctatcgcagtacaagatatgtaatgatatagtacttgcatgctcgtgctttcttgcatatgattgcttttcgaaagggaatataaatgccctcgaaaatttacttatcccttgcaatgatctctggtttaagcatagattatttcaaggacttccaaagaaaatgatttgacattcttttttccccttttttcagctaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaagctacggagagggtcgatggatcatgacgtacgcgtaccatatggttgctgtgcctgcccccatcgatcgcgagcaatggcacgctcatgcaagtgatcattgctccctgttggttaaaccctagcctatgttcatggcgtcagcaactaagctaaactattgttatgtttgcaagaaagggtaaacccgctagctgtgtaatcttgtccagctaccatgtatgcttgttactgcccagttacccttgaaatctaggggcgcttttggtgagagggtgcagtttactttaaacatggttcgtgacttgctgtaaatagtagtattaatcgatttgggcatctagtaagtaaattaagggtgtgtttgatttggcttttactctctaaaagttaaaagctaaattaaagagctggatctagaaaatagacttttctaaaagccgactttgtgatggtgcaaaattgaaagcgtcttagcttttggctaaagagttgtttggtttgactcttttgtcctctaaaaaccaaaagtcaaaccaaagagctagatctaaaaacacgtttttttttctttctaaaaatcgtctttctcatttggacctacttttagtgtcttttaaagcatctttggacctactttttacggcttttaatggtttcactaaatggtttttaactttttaacaactcacaatctacatcaatttttttttcatagcttgtagtctacaacaacattttttacaacctacaatctaaccaaatagaccctaactaatgggagaatgaaaaaaaaatcgctcgatcttatgctattgatgcatgacatgtgaaaccatgaggctcatttttgaacgattggatacataaacctagcgatgcttcactgtgacatccggcgcatatctgtatgtttagtgtactttgtttctgtagtttttccttaagtgtagtgcaacttcttatctggtgttttattcggtgtatcgttgtaatcatctagtacggacccgaattcattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcagggatcctaggatttggtgcctgatgagtccgtgaggacgaaacgagtaagctcgtcgcaccacagcatagcaagttaaaataaggctagtccgttatcaacttgaaaaagtggcaccgagtcggtgcttggccggcatggtcccagcctcctcgctggcgccggctgggcaacatgcttcggcatggcgaatgggacagatctggtagtctgatgagtccgtgaggacgaaacgagtaagctcgtcactacccggactactacttcgttttagagctatgctgtggtgttggccggcatggtcccagcctcctcgctggcgccggctgggcaacatgcttcggcatggcgaatgggactagttgactagtcggctgatgagtccgtgaggacgaaacgagtaagctcgtcccgactggaactccatcttcgttttagagctatgctgtggtgttggccggcatggtcccagcctcctcgctggcgccggctgggcaacatgcttcggcatggcgaatgggacgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaatagactacggaccgctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagctaaaccatgcagaagctgatcaacagcgtgcagaactacgcctggggcagcaagaccgccctgaccgagctgtacggcatggagaaccccagcagccagccaatggccgagctgtggatgggcgcccaccccaaaagctcaagccgcgtgcagaacgccgccggcgatatcgttagcctgcgcgacgtgatcgagagcgacaagagcaccctgctgggcgaggccgtggccaagcgcttcggcgagctgcccttcctgttcaaggtgctgtgcgccgctcagcccctgagcatccaggtgcaccctaacaagcacaacagcgagatcggcttcgccaaggagaacgccgccggcatcccaatggacgccgccgagcgcaactacaaggaccccaaccacaagcccgagctggtgttcgccctgacccccttcctggccatgaacgccttccgcgagttcagcgagatcgttagcctgctgcagcccgtggccggcgcccaccccgctatcgcccacttccttcagcagcccgacgccgagcgcctgagcgagctgttcgccagcctgctgaacatgcagggtgaggagaagtcacgcgccctggccatcctgaagagcgccctggacagccagcagggcgagccctggcagacaatccgcctgatcagcgagttctaccccgaggatagcggcctgttcagccccctgctgctgaacgtggtgaagctgaaccccggcgaggccatgttcctgttcgccgagactccccacgcctacctgcagggcgtggccctggaggtgatggccaacagcgacaacgtgctgcgcgccggcctgacccccaagtacatcgacatccccgagctggtggccaacgtgaagttcgaggctaagcccgccaaccagctgctgacccagcccgtgaagcagggcgccgagctggacttccctatccccgttgacgacttcgccttcagcctgcacgacctgagcgacaaggagactactatcagccagcagagcgccgcgatcctgttctgcgtggagggcgacgccaccctgtggaagggcagccagcagctgcagctgaagcccggcgagagcgcctttatcgccgccaacgagagccccgtgaccgtgaagggccacggccgcctggcccgcgtgtacaacaagctgtgataggattacctagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctgctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgtgaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgccgatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggaaacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggcggcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcgggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggactctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgatgagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 534 - DNA, 3724 bp, Artificial sequence
  synthesized vector
attattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggaaacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggcggcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcgggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggactctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgatgagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 535 - DNA, 2252 bp, Artificial sequence
  synthesized vector
ggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggactctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgatgagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 536 - DNA, 4211 bp, Artificial sequence
  synthesized vector
cggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgtgaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgccgatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggaaacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggcggcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcgggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggactctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgatgagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 537 - DNA, 17568 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttatagccgtttctttgttttttttcttctgttgagctccaactttatgaaacgtcgtaagctggtaattatgaaatgtaaggatttggagagagaaaaaaaacgggagggaaaaccatgcatgctgctgacgcgacggccggacgcagacgcaacaatgcccccggtgcggcgttgtcgagcagccactgcaccaccccacgcatcacctgcagtaatctagcgacgggtttttcttatttatttatttatttatttatttttcttctctccctccctccctcagatttgttttcgttttcattaatcgttattaccagcaattaattaactttatctattgatttaccaaaccgcaataaagaatatatatattcttttattaaggtccagtaataagcagcacagaagcgcaggtgcagcagcagcagcgtcagcgcccgaggcgcgcacgagagaaacagaggctgacgaggtggggcccgtgcgggccttgaccaatcggagttcgacaacagcctggccacccacaaacacacactccttcgcctcgcgccggccgtcgtcgcctccctccaccgaacgatccctcctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgaaggggcgcggcaaggtacagctgaagcggatagagaacaagataaaccggcaggtgaccttctccaagcgccggaacggcctgctcaagaaggcgcacgagatctccgtcctctgcgttgccgaggtcgccgtcatcgtcttctcccccaagggcaagctctacgagtacgccaccgactcccggtacgtacgaccaccttcaattcgtcacacaggcagtgtgtttgttgaattgaatacgtgcctgctatgctagctgcctgtcagtatggtccatccgttcgccatcagttcatctttctgcttcgtgctgctgttgtgtgtgtgcgccataccatgccatgccatgccatgccaccaacctggctgtgctgccgtttttggctcgcagccgccgatccccgacccgaaagctcatgctgctcttgccgttttcggccaccacccaccatggcctgctgtctggtcctccacgcctgcttccccagttccacttccatgcatggtggtcagttggctggcatggcagcagcagccgccttctggttcgtttgtgctgcctcaggatttgctttctactagctagtgtgctacagccgatcatttcatgctgctgcccgcgtcgatctgctccgctagctgcttcctcgtttcgggaaacctcgcccgccccgccattaactgattcacctgctttccttctgttgcggtgttgcctacgacgactgaaacctttcctttttggggattggcgtctgccgactccactaggcctccttttaattccttgttttatatacatgtacataagcttttgctgatgcagtggtacggtgcctttatttttatcggattacagtacgtgttagattgataacagcacgcaatcagatctagctttgcttgcttccttccttcctcgtcaaatctttctggcccttctcgatttgcgctccatcgtataattaattaaccatcactaatcacactttccccatttttctaaacaaaaaaaagtatcacatgttcctaatcacgcgtgcatgtaatttgctgtttctttctctctctctctcaattaatttgctgcctgccgagaaacacgagctgcatgctggctcaatcagttcctaactgcgaaagtgcagataatgaccccctcggctcggattaatcagtacacaaatttacttatcccttgcaatgatctctggtttaagcatagattatttcaaggacttccaaagaaaatgatttgacattcttttttccccttttttcagctaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaagctacggagagggtcgatggatcatgacgtacgcgtaccatatggttgctgtgcctgcccccatcgatcgcgagcaatggcacgctcatgcaagtgatcattgctccctgttggttaaaccctagcctatgttcatggcgtcagcaactaagctaaactattgttatgtttgcaagaaagggtaaacccgctagctgtgtaatcttgtccagctaccatgtatgcttgttactgcccagttacccttgaaatctaggggcgcttttggtgagagggtgcagtttactttaaacatggttcgtgacttgctgtaaatagtagtattaatcgatttgggcatctagtaagtaaattaagggtgtgtttgatttggcttttactctctaaaagttaaaagctaaattaaagagctggatctagaaaatagacttttctaaaagccgactttgtgatggtgcaaaattgaaagcgtcttagcttttggctaaagagttgtttggtttgactcttttgtcctctaaaaaccaaaagtcaaaccaaagagctagatctaaaaacacgtttttttttctttctaaaaatcgtctttctcatttggacctacttttagtgtcttttaaagcatctttggacctactttttacggcttttaatggtttcactaaatggtttttaactttttaacaactcacaatctacatcaatttttttttcatagcttgtagtctacaacaacattttttacaacctacaatctaaccaaatagaccctaactaatgggagaatgaaaaaaaaatcgctcgatcttatgctattgatgcatgacatgtgaaaccatgaggctcatttttgaacgattggatacataaacctagcgatgcttcactgtgacatccggcgcatatctgtatgtttagtgtactttgtttctgtagtttttccttaagtgtagtgcaacttcttatctggtgttttattcggtgtatcgttgtaatcatctagtacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 538 - DNA, 19725 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 539 - DNA, 19084 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 540 - DNA, 19130 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaagaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 541 - DNA, 21121 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagcaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 542 - DNA, 19425 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctagcaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 543 - DNA, 18751 bp, Artificial sequence
  synthesized vector
gaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcctaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaaattagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttaacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccg

SEQ ID NO: 544 - DNA, 19125 bp, Artificial sequence
  synthesized vector
gaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcactgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttagattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcctaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaaattagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttaacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccg

SEQ ID NO: 545 - DNA, 17717 bp, Artificial sequence
  synthesized vector
gaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtacctgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcactgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcctaacctaggccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcaaattagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttaacggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccg

SEQ ID NO: 546 - DNA, 21 bp, Artificial sequence
  Primer
ctaactcgttgagtggccctg

SEQ ID NO: 547 - DNA, 20 bp, Artificial sequence
  Primer
cagataagccgccaagaagg

SEQ ID NO: 548 - DNA, 378 bp, Zea mays;
ctaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatacaacaactcgcggttgacttgcgccttcttggcggcttatctg

SEQ ID NO: 549 - DNA, 175 bp, Zea mays derived;; identical to SEQ ID NO: 369

SEQ ID NO: 550 - DNA, 174 bp, Zea mays derived;; identical to SEQ ID NO: 206

SEQ ID NO: 551 - DNA, 171 bp, Zea mays derived;; identical to SEQ ID NO: 225

SEQ ID NO: 552 - DNA, 166 bp, Zea mays derived;; identical to SEQ ID NO: 333

SEQ ID NO: 553 - DNA, 174 bp, Zea mays derived;; identical to SEQ ID NO: 206

SEQ ID NO: 554 - DNA, 175 bp, Zea mays derived;; identical to SEQ ID NO: 103
  misc_feature (26)..(26): n is a, c, g, or t

SEQ ID NO: 555 - DNA, 175 bp, Zea mays derived;; identical to SEQ ID NO: 369

SEQ ID NO: 556 - DNA, 173 bp, Zea mays derived;; identical to SEQ ID NO: 269

SEQ ID NO: 557 - DNA, 171 bp, Zea mays derived;; identical to SEQ ID NO: 225

SEQ ID NO: 558 - DNA, 175 bp, Zea mays derived;; identical to SEQ ID NO: 103
  misc_feature (26)..(26): n is a, c, g, or t

SEQ ID NO: 559 - DNA, 174 bp, Zea mays derived;; identical to SEQ ID NO: 199

SEQ ID NO: 560 - DNA, 172 bp, Zea mays derived;; identical to SEQ ID NO: 227

SEQ ID NO: 561 - DNA, 167 bp, Zea mays derived;
tgggaggccggcaagccacgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 562 - DNA, 175 bp, Zea mays derived;; identical to SEQ ID NO: 103
  misc_feature (26)..(26): n is a, c, g, or t

SEQ ID NO: 563 - DNA, 169 bp, Zea mays derived;; identical to SEQ ID NO: 263

SEQ ID NO: 564 - DNA, 171 bp, Zea mays derived;; identical to SEQ ID NO: 225

SEQ ID NO: 565 - DNA, 175 bp, Zea mays derived;; identical to SEQ ID NO: 235
  misc_feature (26)..(27): n is a, c, g, or t

SEQ ID NO: 566 - DNA, 171 bp, Zea mays derived;; identical to SEQ ID NO: 225

SEQ ID NO: 567 - DNA, 167 bp, Zea mays derived;; identical to SEQ ID NO: 561

SEQ ID NO: 568 - DNA, 175 bp, Zea mays derived;; identical to SEQ ID NO: 369

SEQ ID NO: 569 - DNA, 175 bp, Zea mays derived;; identical to SEQ ID NO: 103
  misc_feature (26)..(26): n is a, c, g, or t

SEQ ID NO: 570 - DNA, 175 bp, Zea mays derived;; identical to SEQ ID NO: 103
  misc_feature (26)..(26): n is a, c, g, or t

SEQ ID NO: 571 - DNA, 171 bp, Zea mays derived;; identical to SEQ ID NO: 225

SEQ ID NO: 572 - DNA, 175 bp, Zea mays derived;; identical to SEQ ID NO: 369

SEQ ID NO: 573 - DNA, 172 bp, Zea mays derived;; identical to SEQ ID NO: 360

SEQ ID NO: 574 - DNA, 160 bp, Zea mays derived;
tgggaggccggcaagccactgtcggtagcgcctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 575 - DNA, 147 bp, Zea mays derived;
tgggaggccggcaagcccctccgcaggccatggaggtgcgcgtcaagatcctcttcacctcgctctgccacaccgacgtctacttctgggaggccaaggtatctaatcagccatcccatttgtgatctttgtcagtagatatgatac

SEQ ID NO: 576 - DNA, 175 bp, Zea mays derived;; identical to SEQ ID NO: 103
  misc_feature (26)..(26): n is a, c, g, or t

SEQ ID NO: 577 - DNA, 175 bp, Zea mays derived;; identical to SEQ ID NO: 369

SEQ ID NO: 578 - DNA, 175 bp, Zea mays derived;; identical to SEQ ID NO: 369

SEQ ID NO: 579 - DNA, 172 bp, Zea mays derived;; identical to SEQ ID NO: 360

SEQ ID NO: 580 - DNA, 175 bp, Zea mays derived;; identical to SEQ ID NO: 103
  misc_feature (26)..(26): n is a, c, g, or t

SEQ ID NO: 581 - DNA, 175 bp, Zea mays derived;; identical to SEQ ID NO: 369

SEQ ID NO: 582 - DNA, 175 bp, Zea mays derived;; identical to SEQ ID NO: 103
  misc_feature (26)..(26): n is a, c, g, or t

SEQ ID NO: 583 - DNA, 175 bp, Zea mays derived;; identical to SEQ ID NO: 369

SEQ ID NO: 584 - DNA, 175 bp, Zea mays derived;; identical to SEQ ID NO: 103
  misc_feature (26)..(26): n is a, c, g, or t

SEQ ID NO: 585 - DNA, 175 bp, Zea mays derived;; identical to SEQ ID NO: 369

SEQ ID NO: 586 - DNA, 175 bp, Zea mays derived;; identical to SEQ ID NO: 103
  misc_feature (26)..(26): n is a, c, g, or t

SEQ ID NO: 587 - DNA, 175 bp, Zea mays derived;; identical to SEQ ID NO: 103
  misc_feature (26)..(26): n is a, c, g, or t

SEQ ID NO: 588 - DNA, 171 bp, Zea mays derived;; identical to SEQ ID NO: 225

SEQ ID NO: 589 - DNA, 171 bp, Zea mays derived;; identical to SEQ ID NO: 225

SEQ ID NO: 590 - DNA, 167 bp, Zea mays derived;; identical to SEQ ID NO: 561

SEQ ID NO: 591 - DNA, 175 bp, Zea mays derived;; identical to SEQ ID NO: 103
  misc_feature (26)..(26): n is a, c, g, or t

SEQ ID NO: 592 - DNA, 174 bp, Zea mays derived;; identical to SEQ ID NO: 199

SEQ ID NO: 593 - DNA, 175 bp, Zea mays derived;; identical to SEQ ID NO: 103
  misc_feature (26)..(26): n is a, c, g, or t

SEQ ID NO: 594 - DNA, 175 bp, Zea mays derived;; identical to SEQ ID NO: 103
  misc_feature (26)..(26): n is a, c, g, or t

SEQ ID NO: 595 - DNA, 175 bp, Zea mays derived;; identical to SEQ ID NO: 369

SEQ ID NO: 596 - DNA, 171 bp, Zea mays derived;; identical to SEQ ID NO: 225

SEQ ID NO: 597 - DNA, 175 bp, Zea mays derived;; identical to SEQ ID NO: 103
  misc_feature (26)..(26): n is a, c, g, or t

SEQ ID NO: 598 - DNA, 174 bp, Zea mays derived;; identical to SEQ ID NO: 206

SEQ ID NO: 599 - DNA, 175 bp, Zea mays derived;; identical to SEQ ID NO: 369

SEQ ID NO: 600 - DNA, 175 bp, Zea mays derived;; identical to SEQ ID NO: 103
  misc_feature (26)..(26): n is a, c, g, or t

SEQ ID NO: 601 - DNA, 175 bp, Zea mays derived;; identical to SEQ ID NO: 369

SEQ ID NO: 602 - DNA, 175 bp, Zea mays derived;; identical to SEQ ID NO: 103
  misc_feature (26)..(26): n is a, c, g, or t

SEQ ID NO: 603 - DNA, 175 bp, Zea mays derived;; identical to SEQ ID NO: 369

SEQ ID NO: 604 - DNA, 174 bp, Zea mays derived;; identical to SEQ ID NO: 206

SEQ ID NO: 605 - DNA, 171 bp, Zea mays derived;; identical to SEQ ID NO: 225

SEQ ID NO: 606 - DNA, 174 bp, Zea mays derived;; identical to SEQ ID NO: 206

SEQ ID NO: 607 - DNA, 174 bp, Zea mays derived;; identical to SEQ ID NO: 199

SEQ ID NO: 608 - DNA, 175 bp, Zea mays derived;; identical to SEQ ID NO: 103
  misc_feature (26)..(26): n is a, c, g, or t

SEQ ID NO: 609 - DNA, 175 bp, Zea mays derived;; identical to SEQ ID NO: 369

SEQ ID NO: 610 - DNA, 175 bp, Zea mays derived;; identical to SEQ ID NO: 103
  misc_feature (26)..(26): n is a, c, g, or t

SEQ ID NO: 611 - DNA, 175 bp, Zea mays derived;; identical to SEQ ID NO: 369

SEQ ID NO: 612 - DNA, 23287 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttgatcgcggccgctaatatggacaagaagtacagcatcggcctggcaatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctcgttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcacggaccgtggcagacaaagtggcagacatactgtcccacaaatgaagatggaatctgtaaaagaaaacgcgtgaaataatgcgtctgacaaaggttaggtcggctgcctttaatcaataccaaagtggtccctaccacgatggaaaaactgtgcagtcggtttggctttttctgacgaacaaataagattcgtggccgacaggtgggggtccaccatgtgaaggcatcttcagactccaataatggagcaatgacgtaagggcttacgaaataagtaagggtagtttgggaaatgtccactcacccgtcagtctataaatacttagcccctccctcattgttaagggagcaaaatctcagagagatagtcctagagagagaaagagagcaagtagcctagaagtcctaggccatggcgtctaacttcacacagttcgtcctcgtggataatgggggcacaggggatgtcacagttgctccttctaatttcgctaacggcgtcgccgagtggatcagctccaacagcaggtcccaggcctacaaggtgacctgctccgtgaggcagtccagcgcccagaagaggaagtacaccatcaaggtcgaggtgccgaaggtggccacgcagaccgtgggcggcgtcgagctgcccgtggccgcgtggcgctcctacctcaacatggagctgaccatcccgatcttcgccacgaactccgactgcgagctgatcgtcaaggccatgcagggcctgctcaaggacggcaacccgatccccagcgccatcgccgcgaactccggcatctacagcgccggtggcggtggatctggcgggggcgggtccggtggaggcgggagcggccccaagaaaaagaggaaggtggcggccgcgggcagcatggactccctgctcatgaaccgcagggagttcctgtaccagttcaagaacgtccgctgggccaagggccgcagggagacgtacctgtgctacgtcgtgaagaggcgcgactccgccaccagcttctccctggacttcggctacctgaggaacaagaacggctgccacgtcgagctgctcttcctgaggtacatcagcgactgggacctcgacccgggccgctgctacagggtgacgtggttcatcagctggtccccgtgctacgactgcgccaggcacgtggcggacttcctcaggggcaacccgaacctgtccctcaggatcttcaccgccaggctgtacttctgcgaggacaggaaggccgagccggagggcctgaggcgcctgcacagggcgggcgtgcagatcgccatcatgacgttcaaggactacttctactgctggaacaccttcgtcgagaaccacggccgcacgttcaaggcgtgggagggcctgcacgagaactccgtgaggctgtcccgccagctcaggcgcatcctgctcccgctctacgaggtggacgacctcagggacgccttcaggacctgcacgggctcgggggaggggcggggctcactgctcacttgcggcgatgtggaggagaacccagggtgagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcaaacacccggcaagccactgtcgatcggttttagagctaggccaacatgaggatcacccatgtctgcagggcctagcaagttaaaataaggctagtccgttatcaacttggccaacatgaggatcacccatgtctgcagggccaagtggcaccgagtcggtgctttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 613 - DNA, 24324 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttcctaggccatggctcctaagaagaagcggaaggttggtattcacggggtgcctgcggctatggacaagaagtacagcatcggcctggccatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctggccgacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccggccctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaaggccccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgggctccagcgagacacccggcacctccgagtcggctaccccggagggcggctccggcggctccggcagcgtgcagatcccccagaacccactcatcctcgtggacggctccagctacctctacagggcctaccacgctttcccgcccctgacgaactccgcgggcgagccgaccggcgctatgtacggcgtgctcaacatgctgcgcagcctcatcatgcagtacaagccgacccacgccgcggtggtgttcgacgccaagggcaagaccttcagggacgagctgttcgagcactacaagagccacaggccgccgatgcccgacgacctcagggcccagatcgagccactgcacgcgatggtgaaggcgatgggcctcccgctcctggcggtgtccggcgtggaggcggacgacgtgatcggcacgctcgccagggaggcggagaaggccggcaggcccgtgctgatcagcaccggcgacaaggacatggcgcagctcgtcacgccgaacatcaccctgatcaacaccatgacgaacaccatcctgggccccgaggaggtggtcaacaagtacggcgtgccgcccgagctgatcatcgacttcctcgccctgatgggcgactcgtcggacaacatccccggcgtgcccggcgtcggcgaaaagaccgcccaggccctcctccagggcctcggcggcctcgacaccctgtacgccgagcccgagaagatcgcgggcctctccttccgcggcgctaagacgatggccgcgaagctggagcagaacaaggaggtggcgtacctcagctaccagctggccacgatcaagaccgacgtggagctggagctgacctgcgagcagctggaggtgcagcagccggccgcggaggagctgctcggcctcttcaagaagtacgagttcaagaggtggaccgccgacgtggaggcgggcaagtggctccaggctaagggcgctaagccagccgccaagccacaggagacatccgtggctgacgaggccccggaggtgaccgctaccgtcatcagctacgacaactacgtcacgatcctcgacgaggagacactgaaggcctggatcgcgaagctggagaaggccccggtgttcgccttcgacacggagacagactccctcgacaacatcagcgcgaacctcgtcggcctgtccttcgccatcgagcccggcgtggcggcctacatcccggtggcccacgactacctcgacgctcccgaccagatctcgagggagagggcgctggagctgctgaagccactcctggaggacgagaaggccctcaaggtcggccagaacctgaagtacgcccgcggcatcctcgccaactacggcatcgagctgaggggcatcgccttcgacaccatgctcgagtcctacatcctgaacagcgtggccggccgccacgacatggactccctcgccgagaggtggctgaagcacaagacgatcaccttcgaggagatcgcgggcaagggcaagaaccagctcacgttcaaccagatcgccctggaggaggcgggcaggtacgccgcggaggacgccgacgtgaccctccagctgcacctcaagatgtggcccgacctccagaagcacaagggccccctgaacgtgttcgagaacatcgagatgccgctcgtgcccgtcctgtccaggatcgagaggaacggcgtgaagatcgacccgaaggtcctccacaaccactcggaggagctgaccctcaggctggcggagctggagaagaaggcgcacgagatcgccggcgaggagttcaacctctccagcacgaagcagctccagaccatcctgttcgagaagcagggcatcaagcccctcaagaaaaccccgggcggcgctccgtccacctccgaggaggtgctggaggagctggctctggactaccccctccccaaggtcatcctggagtaccgcggcctcgccaagctgaagtccacgtacaccgacaagctcccgctgatgatcaaccccaagacgggcagggtgcacaccagctaccaccaggcggtcaccgccacgggcaggctctccagcaccgacccgaacctccagaacatccccgtgcgcaacgaggagggccgcaggatcaggcaggccttcatcgcgccggaggactacgtgatcgtgtccgccgactacagccagaacgagctgcgcatcatggcccacctgtcccgggacaagggcctcctgaccgccttcgctgagggcaaggacatccacagggccaccgccgcggaggtgttcggcctcccgctggagacagtcacctccgagcagcgcaggagcgccaagaggatcaacttcggcctgatctacggcatgtcggccttcggcctcgcccgccagctgaacatcccgaggaaggaggcccagaagtacatggacctctacttcgagcgctaccccggcgtgctggagtacatggagaggaccagggcgcaggctaaggagcagggctacgtcgagacactggacggccgcaggctctacctgcccgacatcaagtccagcaacggcgcgcgcagggccgcggccgagagggcggccatcaacgcccccatgcagggcacggcggctgacatcatcaagcgggctatgatcgccgtggacgcttggctccaggccgagcagccgcgcgtgaggatgatcatgcaggtccacgacgagctggtgttcgaggtccacaaggacgacgtggacgcggtcgccaagcagatccaccagctcatggagaactgcacgaggctggacgtgccactcctggtggaagtgggcagcggcgagaactgggaccaggcccactgagagctcgttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcaggaccgtcgacgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacggcaagccactgtcgatcggttttagagctagaaatagcaagttaaaataaggctagtccgttatcaacttgaaaaagtggcaccgagtcggtgctttttttttgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 614 - DNA, 2026 bp, Zea mays derived;
gccgtttctttgttttttttcttctgttgagctccaactttatgaaacgtcgtaagctggtaattatgaaatgtaaggatttggagagagaaaaaaaacgggagggaaaaccatgcatgctgctgacgcgacggccggacgcagacgcaacaatgcccccggtgcggcgttgtcgagcagccactgcaccaccccacgcatcacctgcagtaatctagcgacgggtttttcttatttatttatttatttatttatttttcttctctccctccctccctcagatttgttttcgttttcattaatcgttattaccagcaattaattaactttatctattgatttaccaaaccgcaataaagaatatatatattcttttattaaggtccagtaataagcagcacagaagcgcaggtgcagcagcagcagcgtcagcgcccgaggcgcgcacgagagaaacagaggctgacgaggtggggcccgtgcgggccttgaccaatcggagttcgacaacagcctggccacccacaaacacacactccttcgcctcgcgccggccgtcgtcgcctccctccaccgaacgatccctcctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgaaggggcgcggcaaggtacagctgaagcggatagagaacaagataaaccggcaggtgaccttctccaagcgccggaacggcctgctcaagaaggcgcacgagatctccgtcctctgcgttgccgaggtcgccgtcatcgtcttctcccccaagggcaagctctacgagtacgccaccgactcccggtacgtacgaccaccttcaattcgtcacacaggcagtgtgtttgttgaattgaatacgtgcctgctatgctagctgcctgtcagtatggtccatccgttcgccatcagttcatctttctgcttcgtgctgctgttgtgtgtgtgcgccataccatgccatgccatgccatgccaccaacctggctgtgctgccgtttttggctcgcagccgccgatccccgacccgaaagctcatgctgctcttgccgttttcggccaccacccaccatggcctgctgtctggtcctccacgcctgcttccccagttccacttccatgcatggtggtcagttggctggcatggcagcagcagccgccttctggttcgtttgtgctgcctcaggatttgctttctactagctagtgtgctacagccgatcatttcatgctgctgcccgcgtcgatctgctccgctagctgcttcctcgtttcgggaaacctcgcccgccccgccattaactgattcacctgctttccttctgttgcggtgttgcctacgacgactgaaacctttcctttttggggattggcgtctgccgactccactaggcctccttttaattccttgttttatatacatgtacataagcttttgctgatgcagtggtacggtgcctttatttttatcggattacagtacgtgttagattgataacagcacgcaatcagatctagctttgcttgcttccttccttcctcgtcaaatctttctggcccttctcgatttgcgctccatcgtataattaattaaccatcactaatcacactttccccatttttctaaacaaaaaaaagtatcacatgttcctaatcacgcgtgcatgtaatttgctgtttctttctctctctctctcaattaatttgctgcctgccgagaaacacgagctgcatgctggctcaatcagttcctaactgcgaaagtgcagataatgaccccctcggctcggattaatcagtacacaaatttacttatcccttgcaatgatctctggtttaagcatagattatttcaaggacttccaaagaaaatgatttgacattcttttttccccttttttcagc

SEQ ID NO: 615 - DNA, 4042 bp, Zea mays derived;
ctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaacttt

SEQ ID NO: 616 - DNA, 3401 bp, Zea mays derived;
ctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaacttt

SEQ ID NO: 617 - DNA, 3447 bp, Zea mays derived;
ctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaagaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaacttt

SEQ ID NO: 618 - DNA, 5438 bp, Zea mays derived;
accgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaacttt

SEQ ID NO: 619 - DNA, 3742 bp, Zea mays derived;
accgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaacttt

SEQ ID NO: 620 - DNA, 3208 bp, Oryza sativa derived;
tgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcct

SEQ ID NO: 621 - DNA, 3582 bp, Oryza sativa derived;
tgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcactgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttagattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcct

SEQ ID NO: 622 - DNA, 2174 bp, Oryza sativa derived;
tgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactattgaccatgtattcatatgcactgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggaaggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatcct

SEQ ID NO: 623 - DNA, 1100 bp, Zea mays derived;
gtacgtacgaccaccttcaattcgtcacacaggcagtgtgtttgttgaattgaatacgtgcctgctatgctagctgcctgtcagtatggtccatccgttcgccatcagttcatctttctgcttcgtgctgctgttgtgtgtgtgcgccataccatgccatgccatgccatgccaccaacctggctgtgctgccgtttttggctcgcagccgccgatccccgacccgaaagctcatgctgctcttgccgttttcggccaccacccaccatggcctgctgtctggtcctccacgcctgcttccccagttccacttccatgcatggtggtcagttggctggcatggcagcagcagccgccttctggttcgtttgtgctgcctcaggatttgctttctactagctagtgtgctacagccgatcatttcatgctgctgcccgcgtcgatctgctccgctagctgcttcctcgtttcgggaaacctcgcccgccccgccattaactgattcacctgctttccttctgttgcggtgttgcctacgacgactgaaacctttcctttttggggattggcgtctgccgactccactaggcctccttttaattccttgttttatatacatgtacataagcttttgctgatgcagtggtacggtgcctttatttttatcggattacagtacgtgttagattgataacagcacgcaatcagatctagctttgcttgcttccttccttcctcgtcaaatctttctggcccttctcgatttgcgctccatcgtataattaattaaccatcactaatcacactttccccatttttctaaacaaaaaaaagtatcacatgttcctaatcacgcgtgcatgtaatttgctgtttctttctctctctctctcaattaatttgctgcctgccgagaaacacgagctgcatgctggctcaatcagttcctaactgcgaaagtgcagataatgaccccctcggctcggattaatcagtacacaaatttacttatcccttgcaatgatctctggtttaagcatagattatttcaaggacttccaaagaaaatgatttgacattcttttttccccttttttcag

SEQ ID NO: 624 - DNA, 1636 bp, Zea mays derived;
gtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcag

SEQ ID NO: 625 - DNA, 995 bp, Zea mays derived;
gtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcag

SEQ ID NO: 626 - DNA, 1041 bp, Zea mays derived;
gtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaagaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcag

SEQ ID NO: 627 - DNA, 1008 bp, Oryza sativa derived;
gtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcag

SEQ ID NO: 628 - DNA, 24 bp, Artificial sequence
  Primer
agccttggtggaatgaagttatgt

SEQ ID NO: 629 - DNA, 25 bp, Artificial sequence
  Primer
aatctaagcaagagcaatgcaacat

SEQ ID NO: 630 - DNA, 19 bp, Artificial sequence
  Primer
ggaggcaaaccgcttcatt

SEQ ID NO: 631 - DNA, 23 bp, Glycine max;
gaaggaagaagaggcgcaatagg

SEQ ID NO: 632 - DNA, 24 bp, Glycine max derived;
gaaggaagaagaggcgccaatagg

SEQ ID NO: 633 - DNA, 20 bp, Glycine max;
actacccggactactacttc

SEQ ID NO: 634 - DNA, 20 bp, Glycine max;
actacccggactactacttc

SEQ ID NO: 635 - DNA, 20 bp, Glycine max;
ccgactggaactccatcttc

SEQ ID NO: 636 - DNA, 20 bp, Glycine max;
actacccggactactacttc

SEQ ID NO: 637 - DNA, 15 bp, Artificial sequence
  Primer
ccatcgggacggcga

SEQ ID NO: 638 - DNA, 19 bp, Artificial sequence
  Primer
cttgaggtcggtgaggtgg

SEQ ID NO: 639 - DNA, 18 bp, Artificial sequence
  probe
ctactacttccggatcac

SEQ ID NO: 640 - DNA, 15 bp, Artificial sequence
  primer
cgatcggcaccgcca

SEQ ID NO: 641 - DNA, 19 bp, Artificial sequence
  primer
cttgaggtcggtgaggtgc

SEQ ID NO: 642 - DNA, 18 bp, Artificial sequence
  probe
ctactacttccggatcac

SEQ ID NO: 643 - DNA, 17 bp, Artificial sequence
  primer
gctggaggacgcgttcg

SEQ ID NO: 644 - DNA, 17 bp, Artificial sequence
  primer
tggcctccacctggtcc

SEQ ID NO: 645 - DNA, 18 bp, Artificial sequence
  probe
actccatcttctgggtgg

SEQ ID NO: 646 - DNA, 17 bp, Artificial sequence
  primer
gctggacgacgcgttca

SEQ ID NO: 647 - DNA, 17 bp, Artificial sequence
  primer
tggcctccacctggtcg

SEQ ID NO: 648 - DNA, 18 bp, Artificial sequence
  probe
actccatcttctgggtgg

SEQ ID NO: 649 - DNA, 18 bp, Artificial sequence
  primer
ccgggtgaatcagcgttt

SEQ ID NO: 650 - DNA, 18 bp, Artificial sequence
  primer
gccgtggcctttgacagt

SEQ ID NO: 651 - DNA, 20 bp, Artificial sequence
  probe
tgccgccaacgaatcaccgg

SEQ ID NO: 652 - DNA, 17 bp, Artificial sequence
  primer
gcgccgtcaccgtatcc

SEQ ID NO: 653 - DNA, 18 bp, Artificial sequence
  primer
gctcgtcgggcgtcagta

SEQ ID NO: 654 - DNA, 27 bp, Artificial sequence
  probe
atcagaggcgagcagaaaccacaccac

SEQ ID NO: 655 - DNA, 23 bp, Glycine max;
gaaggaagaagaggcgcaatagg

SEQ ID NO: 656 - DNA, 24 bp, Glycine max derived;
gaaggaagaagaggcgccaatagg

SEQ ID NO: 657 - DNA, 18593 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggactagggcctctactctagtctagagtcactgaatccctttgatcattaggataaagtcaacaagacttacaagagtcatggttttgatttgagctaaaataatttccatgtggcaagaaatttctttcatggagccttggaaagcaagaaatttcttcctaacgttgtttgaacactagcacggtcccatacacacatattaaaataattcattctctagaagcaagcagaaactcaaaattttaaatgattatttcgtgggaagtttgaaattttcacaagttcatgcgataagaaaacatttaattaaggtatttatctctaatgacagattcaagagggagacagcttgtcaaatgaacagttatttgatgcaagtctctttcattgcccgaattatttgtgatgatattgacagaaaatgcagaactttttttgggcatcatctattcatcttttggccaaaaaaattgtcaatctaattctgtggatcagtggatggtcttggaattaggcaagctagatagagacacgaattcagcttttcttgtgtgaaagttgatggaagttactaactcaaccaaatgctctttggatttccattgtcaaagccacagaaagagtgtgcttgattaaagcgtgagtttggttgatttattgaaaaaatactacacaaaattatttgttttatgttggttttagaaattattatacaaaaaaataaaatgaaaaaaatgaaaaaaatttaaatattcattactgctcaaattatggaacaaatttttatctcatgagtcatcatgaaacaattttttatctcatgaagtgcatatgctggagttggttcccgtgggttgttgtattttgcttaatatggattgttccctggactagttcatttgtagtttttgtttgtttggggccttgggccattcttatcactaaaacacacacatgcacgcttaccaacaactcatttgatttcttatgacaattttttttctaatcacgataataataccaaatattcataatcaaaaaagttaagattcaaaccttatattatttagttaagaaatataggtctttatcatttgtgttaatcggttattattttttttctttcatttaattttaaaatattcatctccttaaaaaaattccaatgaccctaaaggagggttagtatacaactaaaactaaccaagtccctttttttaaaaaaaaatacattaattaaatatctctatctcagaggctgtttgattgagtcaaaagagaataaaaaataagtaaaataaacagtaaaattttataaaatccatatttttattctcaatttaaattttcatttatttttacctttatttttttttccactctaccaaacatgtacttagatttgaccataaaagaactcgagcaaacagaaattcgaccattcacttcatttactcattgactagtttctcaccgtcgatgataaatcatcaacgctccccgtgatcccctccaccgttacaaacttgtgcccctacctacactaaccccaaatgcaattcaacttttaaaaggcgccaacactttaactgaatcagtttgttcagttaaagcgctctctctctctctctgttcttcctcttcgcacgaaaacacgatgcgacagagatcgtaatcgaagccaaaaccaattttccataatcataatcaacactgtctttcgctctcatcgaagcctgcaagaagcgtaaacggttgccgaagtttttcaggttcaactcgttcggcgaccctggtgttgttccaattgcacgttcgggtcccttccgcgataacgttcgcgttttccttcaagaagctggcgatctcgaagactacactgtctccgggaaccccctctggtgcattcttctcatccacgacaactcgtacgctctggctcctctttacaccatcgaagaacacgtcgaccactcttcgcaccccttctgcgatcactgccgctgcgtaggttcgtttccgaatttcgccttcttgggtttggtttgattgttgattcttgaaatggggttgcttcaagtttgggttttttgcttgatttttgaaatgggtctgaataatgtgattgcgttttgttgcttgtttctgaaaaggttttttttttacgtgttttgtggttttattttcgtcctgattgagttaatctgtttcgggtattttgatacgggtgatgatgtgggctgtttccaattttggatttttttctatagtagggtattgttgagaagggttgcttagtggtttgggttgtttgagaaaatgtgtattttaatttttgtttatcattttgaattacaaaacggatacttttttttatttaagttatggtttttgaagagtttgaaaaggaaaaatacttttcattgatttctgattatagactatagagacttttgaaaatagaaagaatgagaaaaaatgtgacatttttgtgattggaaatgaaaacagaagcattttcttctgacaagttttccaaaaatggctgtggagtatagtatagggactagggttatcattgatactgataatgataccaatatgcggctttgtttggttaaaagtttgtaaaggaaaaaacacttcccattgatcatattattgtttggtatacagacttttgaaaatagaaacagtgaatacatgaattctatgattagaaatgaaaacagaaacatttttttatgactagtattccaaaaatgttgatttattatgaaaagggttggtaggaagtttgatgattttgaattttggataatgggttttagaactactgatgtcgatattaatatttgactttgtttggtcaataattgataggttggagtggacattatggataagaagtattctattggacttgatattggaaccaactctgtgggatgggctgttattactgacgagtataaggttccatctaagaagttcaaggttcttggaaacactgatagacactctattaagaagaaccttattggtgctcttcttttcgattctggagagactgctgaggctactagacttaagagaactgctagaagaagatatactagaagaaagaacagaatttgctatcttcaagagattttctctaacgagatggctaaggttgacgattctttcttccacagacttgaggagtctttccttgttgaggaggataagaagcacgagagacacccaattttcggaaacattgttgacgaggttgcttatcacgagaagtatccaactatttatcaccttagaaagaagctcgttgattctactgataaggctgatcttagacttatttatcttgctcttgctcacatgattaagttcagaggacacttccttattgagggagatcttaacccagataactctgacgttgataagctcttcattcaacttgttcaaacttataaccaacttttcgaggagaacccaattaacgcttctggagttgacgctaaggctattctttctgctagactttctaagtctagaaggcttgagaaccttattgctcaacttccaggagagaagaagaacggacttttcggaaaccttattgctctttctcttggacttactccaaacttcaagtctaacttcgatcttgctgaggacgctaagctccaactttctaaggatacttacgacgatgatcttgataaccttcttgctcaaattggagatcaatacgctgatcttttccttgctgctaagaacctttctgacgctattcttctttctgatattcttagagttaacactgagattactaaggctccactttctgcttctatgattaagagatacgacgagcaccaccaagatcttactcttcttaaggctcttgttagacaacaacttccagagaagtataaggagattttcttcgatcaatctaagaacggatacgctggatatattgacggaggagcttctcaagaggagttctataagttcattaagccaattcttgagaagatggacggaactgaggagcttcttgttaagctcaacagagaggatcttcttagaaagcaaagaactttcgataacggatctattccacaccaaattcaccttggagagcttcacgctattcttagaaggcaagaggatttctatccattccttaaggataacagagagaagattgagaagattcttactttccgtattccatattacgttggaccacttgctagaggaaactctagattcgcttggatgactagaaagtctgaggagactattactccttggaacttcgaggaggttgttgataagggagcttctgctcaatctttcattgagagaatgactaacttcgataagaaccttccaaacgagaaggttcttccaaagcactctcttctttacgagtatttcactgtttataacgagcttactaaggttaagtacgttactgagggaatgagaaagccagctttcctttctggagagcaaaagaaggctattgttgatcttcttttcaagactaacagaaaggttactgttaagcaacttaaggaggattatttcaagaagattgagtgcttcgattctgttgagatttctggagttgaggatagattcaacgcttctcttggaacttatcacgatcttcttaagattattaaggataaggatttccttgataacgaggagaacgaggatattcttgaggatattgttcttactcttactcttttcgaggatagagagatgattgaggagagacttaagacttacgctcaccttttcgacgataaggttatgaagcaacttaagagaagaagatatactggatggggtagactttctagaaagctcattaacggaattagagataagcaatctggaaagactattcttgatttccttaagtctgacggattcgctaacagaaacttcatgcaacttattcacgacgattctcttactttcaaggaggatattcaaaaggctcaagtttctggacaaggagattctcttcacgagcacattgctaaccttgctggatctccagctattaagaagggaattcttcaaactgttaaggttgttgacgagcttgttaaggttatgggtagacacaagccagagaacattgttattgagatggctagagagaaccaaactactcaaaagggacaaaagaactctagagagagaatgaagagaattgaggagggaattaaggagcttggatctcaaattcttaaggagcacccagttgagaacactcaacttcaaaacgagaagctctatctttattatcttcaaaacggaagagatatgtacgttgatcaagagcttgatattaacagactttctgattacgacgttgatcacattgttccacaatctttccttaaggacgattctattgataacaaggttcttactagatctgataagaacagaggaaagtctgataacgttccatctgaggaggttgttaagaagatgaagaactattggagacaacttcttaacgctaagctcattactcaaagaaagttcgataaccttactaaggctgagagaggaggactttctgagcttgataaggctggattcattaagagacaacttgttgagactagacaaattactaagcacgttgctcaaattcttgattctagaatgaacactaagtacgacgagaacgataagctcattagagaggttaaggttattactcttaagtctaagctcgtttctgatttcagaaaggatttccaattctataaggttagagagattaacaactatcaccacgctcacgacgcttatcttaacgctgttgttggaactgctcttattaagaagtatccaaaacttgagtctgagttcgtttacggagattataaggtttacgacgttagaaagatgattgctaagtctgagcaagagattggaaaggctactgctaagtatttcttctattctaacattatgaacttcttcaagactgagattactcttgctaacggagagattagaaagaggccacttattgagactaacggagagactggagagattgtttgggataagggaagagatttcgctactgttagaaaggttctttctatgccacaagttaacattgttaagaaaactgaggttcaaactggaggattctctaaggagtctattcttccaaagagaaactctgataagctcattgctagaaagaaggattgggacccaaagaagtacggaggattcgattctccaactgttgcttattctgttcttgttgttgctaaggttgagaagggaaagtctaagaagctcaagtctgttaaggagcttgttggaattactattatggagagatcttctttcgagaagaacccagttgatttccttgaggctaagggatataaggaggttaagaaggatcttattattaagctcccaaagtattctcttttcgagcttgagaacggaagaaagagaatgcttgcttctgctggagagcttcaaaagggaaacgagcttgctcttccatctaagtacgttaacttcctttatcttgcttctcactacgagaagctcaagggatctccagaggataacgagcaaaagcaacttttcgttgagcaacacaagcactatcttgacgagattattgagcaaatttctgagttctctaagagagttattcttgctgacgctaaccttgataaggttctttctgcttataacaagcacagagataagccaattagagagcaagctgagaacattattcaccttttcactcttactaaccttggtgctccagctgctttcaagtatttcgatactactattgatagaaagagatatacttctactaaggaggttcttgacgctactcttattcaccaatctattactggactttacgagactagaattgatctttctcaacttggaggagattcttctccaccaaagaagaagagaaaggtttcttggaaggacgcttctggatggtctagaatgtgaaatgcttgaatactgcgttgtaagatcaatacatacttgtttctgtttgttcttatttcatttgttgattcttttaatattttttcacacctcttttttttgaagtgaggtgtgttaacgtcccttttgagacgttggttttttgttggtgatttgaaagaacagttcccccttttttttttttttgatactttcaattcagtgaaggaaaaacaataagtggaaggaatagtacttcgtcgttggtgttataaagtttggtatagacacatctcacatatgtattaagtattcgatattatagtggattttgataatggatttgttaataatatactgatatcaattctcataaaaaaatattttatttttatttttttgaattctcgaaattattaattattattgtaaaaaagttacaatgaaaataaacatctgatagatgataatggatccagtttagttacccttactccatttccctctaattgtgatgaataaagcacgtatttgcaaaacgatacatagtgcatatcacgtttattgatgagtaaaataattggttatcatcagcttgcattttactacataacataacttatacgtcaacagcagtgttaaaatagttttacacaaagtggtgtatgactagatctagaaaatatttattggataaaatttatttaaatttataaaaaatttattctcatttttatttaatgaatatcaattattgtttagtaatttttaataattttaattaactagtgtttaatgcacgggcttactcatttttttttactactttgtttatatagccaataaatttttttttaaaaaaagataataatatatctcaagaaattagaaactataaaatttgaagaaaaaaaaggggactatatagcacatcgaatttatttttggaaaaaagagataagctatctccaacaaattaaagactataatttttttaaaaaaaataagaaaaaatgaataacggacccaagcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgataccggatttgcgagaagcgttttagagctagaaatagcaagttaaaataaggctagtccgttatcaacttgaaaaagtggcaccgagtcggtgctttttttttctaattagctaaaactaattaaagaaaataaaaatgcaagtgcggtgacaagacaagctagaataaagttgcaaagaaatgacagggctacaaaaggctcacctacttctggatttaccaaacttctgtttgtccccatactccaaaaacaaaaccatttttttttatcttcgtttttgtttgctttgactgtgagttgaggcccaactttctgcttctgtccgactctatttgatgaattttgtttgcctcctgtgatgtgaaggatgtatcattgaaagggaacgtgtctcaatgatcccacatcggccaaatatgctcattacattgcgtttatatagtcccaggaaaacatatggattggaaggaagaagaggcgcaatgttttagagctagaaatagcaagttaaaataaggctagtccgttatcaacttgaaaaagtggcaccgagtcggtgctttttttttcggacccaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagaattcgatatcaagcttgatatcggaagtttctctcttgagggaggttgctcgtggaatgggacacatatggttgttataataaaccatttccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatgtctactgtttttattgattcaatatttgattgttcttttttttgcagatttgttgaccagagatctaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccgtccagcaactgctcgtaagtcctctggtctttctggaaccgtccgtattccaggtgacaagtctatctcccacaggtccttcatgtttggaggtctcgctagcggtgaaactcgtatcaccggtcttttggaaggtgaagatgttatcaacactggtaaggctatgcaagctatgggtgccagaatccgtaaggaaggtgatacttggatcattgatggtgttggtaacggtggactccttgctcctgaggctcctctcgatttcggtaacgctgcaactggttgccgtttgactatgggtcttgttggtgtttacgatttcgatagcactttcattggtgacgcttctctcactaagcgtccaatgggtcgtgtgttgaacccacttcgcgaaatgggtgtgcaggtgaagtctgaagacggtgatcgtcttccagttaccttgcgtggaccaaagactccaacgccaatcacctacagggtacctatggcttccgctcaagtgaagtccgctgttctgcttgctggtctcaacaccccaggtatcaccactgttatcgagccaatcatgactcgtgaccacactgaaaagatgcttcaaggttttggtgctaaccttaccgttgagactgatgctgacggtgtgcgtaccatccgtcttgaaggtcgtggtaagctcaccggtcaagtgattgatgttccaggtgatccatcctctactgctttcccattggttgctgccttgcttgttccaggttccgacgtcaccatccttaacgttttgatgaacccaacccgtactggtctcatcttgactctgcaggaaatgggtgccgacatcgaagtgatcaacccacgtcttgctggtggagaagacgtggctgacttgcgtgttcgttcttctactttgaagggtgttactgttccagaagaccgtgctccttctatgatcgacgagtatccaattctcgctgttgcagctgcattcgctgaaggtgctaccgttatgaacggtttggaagaactccgtgttaaggaaagcgaccgtctttctgctgtcgcaaacggtctcaagctcaacggtgttgattgcgatgaaggtgagacttctctcgtcgtgcgtggtcgtcctgacggtaagggtctcggtaacgcttctggagcagctgtcgctacccacctcgatcaccgtatcgctatgagcttcctcgttatgggtctcgtttctgaaaaccctgttactgttgatgatgctactatgatcgctactagcttcccagagttcatggatttgatggctggtcttggagctaagatcgaactctccgacactaaggctgcttgatgagctcaagaattcgagctcggtaccggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctaattagctaattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 658 - DNA, 22 bp, Glycine max derived;
cgcaataggtcgggaactgtgg

SEQ ID NO: 659 - DNA, 5 bp, Glycine max derived;
cgcaa

SEQ ID NO: 660 - DNA, 9 bp, Glycine max derived;
gaggcgcaa

SEQ ID NO: 661 - DNA, 5 bp, Glycine max derived;
aatag

SEQ ID NO: 662 - DNA, 23 bp, Glycine max;
ccagcttctcgcaaatccggtat

SEQ ID NO: 663 - DNA, 24 bp, Glycine max derived;
ccagctttctcgcaaatccggtat

SEQ ID NO: 664 - DNA, 24 bp, Glycine max derived;
ccagctatctcgcaaatccggtat

SEQ ID NO: 665 - DNA, 45 bp, Glycine max derived;
aaattcgcagctaaaaagcaagcgttgaatccgaagagtgaaggt

SEQ ID NO: 666 - DNA, 21 bp, Glycine max derived;
ccagcttcgcaaatccggtat

SEQ ID NO: 667 - DNA, 57 bp, Glycine max;
aggctcagggaaggaagaagaggcgcaataggtcgggaactgtggcgcttcgtgaga

SEQ ID NO: 668 - DNA, 58 bp, Glycine max derived;
aggctcagggaaggaagaagaggcgcaaataggtcgggaactgtggcgcttcgtgaga

SEQ ID NO: 669 - DNA, 58 bp, Glycine max derived;
aggctcagggaaggaagaagaggcgctaataggtcgggaactgtggcgcttcgtgaga

SEQ ID NO: 670 - DNA, 56 bp, Glycine max derived;
aggctcagggaaggaagaagaggcgcataggtcgggaactgtggcgcttcgtgaga

SEQ ID NO: 671 - DNA, 30 bp, Glycine max derived;
aggctcagggaaggaagaagcttcgtgaga

SEQ ID NO: 672 - DNA, 57 bp, Glycine max;; identical to SEQ ID NO: 667

SEQ ID NO: 673 - DNA, 58 bp, Glycine max derived;; identical to SEQ ID NO: 668

SEQ ID NO: 674 - DNA, 58 bp, Glycine max derived;
aggctcagggaaggaagaagaggcgccaataggtcgggaactgtggcgcttcgtgaga

SEQ ID NO: 675 - DNA, 58 bp, Glycine max derived;; identical to SEQ ID NO: 669

SEQ ID NO: 676 - DNA, 56 bp, Glycine max derived;; identical to SEQ ID NO: 670

SEQ ID NO: 677 - DNA, 56 bp, Glycine max derived;
aggctcagggaaggaagaagaggcgaataggtcgggaactgtggcgcttcgtgaga

SEQ ID NO: 678 - DNA, 54 bp, Glycine max derived;
aggctcagggaaggaagaagaggcgcaggtcgggaactgtggcgcttcgtgaga

SEQ ID NO: 679 - DNA, 51 bp, Glycine max derived;
aggctcagggaaggaagaagaataggtcgggaactgtggcgcttcgtgaga

SEQ ID NO: 680 - DNA, 54 bp, Glycine max derived;
aggctcagggaaggaagaagaggaataggtcgggaactgtggcgcttcgtgaga

SEQ ID NO: 681 - DNA, 51 bp, Glycine max derived;; identical to SEQ ID NO: 679

SEQ ID NO: 682 - DNA, 49 bp, Glycine max derived;
aggctcagggaaggaagaaataggtcgggaactgtggcgcttcgtgaga

SEQ ID NO: 683 - DNA, 57 bp, Glycine max;; identical to SEQ ID NO: 667

SEQ ID NO: 684 - DNA, 58 bp, Glycine max derived;; identical to SEQ ID NO: 668

SEQ ID NO: 685 - DNA, 58 bp, Glycine max derived;; identical to SEQ ID NO: 674

SEQ ID NO: 686 - DNA, 58 bp, Glycine max derived;; identical to SEQ ID NO: 669

SEQ ID NO: 687 - DNA, 54 bp, Glycine max derived;; identical to SEQ ID NO: 680

SEQ ID NO: 688 - DNA, 55 bp, Glycine max derived;
aggctcagggaaggaagaagaggcgctaggtcgggaactgtggcgcttcgtgaga

SEQ ID NO: 689 - DNA, 55 bp, Glycine max derived;
aggctcagggaaggaagaagaggcaataggtcgggaactgtggcgcttcgtgaga

SEQ ID NO: 690 - DNA, 54 bp, Glycine max derived;
aggctcagggaaggaagaagaggcataggtcgggaactgtggcgcttcgtgaga

SEQ ID NO: 691 - DNA, 52 bp, Glycine max derived;
aggctcagggaaggaagaagaaataggtcgggaactgtggcgcttcgtgaga

SEQ ID NO: 692 - DNA, 51 bp, Glycine max derived;; identical to SEQ ID NO: 679

SEQ ID NO: 693 - DNA, 52 bp, Glycine max derived;
aggctcagggaaggaagaagaggcgcgtcgggaactgtggcgcttcgtgaga

SEQ ID NO: 694 - DNA, 48 bp, Glycine max derived;
aggctcagggaaggaagaagaggtcgggaactgtggcgcttcgtgaga

SEQ ID NO: 695 - DNA, 48 bp, Glycine max derived;
aggctcagggaaggaagaataggtcgggaactgtggcgcttcgtgaga

SEQ ID NO: 696 - DNA, 35 bp, Glycine max derived;
aggctcagggaaggaagaagaggcgcttcgtgaga

SEQ ID NO: 697 - DNA, 26984 bp, Artificial sequence
  synthesized vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccctaaaggtaccttaagctaaaacgaaacggagggagtatatataatagtaaaaaatagtttttatggtgctggggcctacgtttataatcttgtcccgggtccctcaaaaatcaggaacgaccctgtgcaagagctgaatgtggcctgacaccaattctcggcacattggtctatgactcaagttttagatccattttttttaaaaaaaggctttacgagaagtttatttataaaaatactacaggagttccaaagaaccctgggctacagtaacttcccaaaaacataatggatattcttctttccactgtagttttttttaaaaaatgatgttggttccggtcctctgccaccagaatggatgagagcttctccgtgtctgttcaaaaattactgactcatggattcagatacaaaatgttatcaacgtgttcaaataaatacattatcaagatacatgtttttttaaaaaaaatgagaaaaataagataaaatatattctagattctgctatttaaaaattgcccaaagttacaaatttaatttagggcaaagctaaaacagtctatagtttttaatatatataaaataatagataaaacgaatcaatcatgtcatcaattatctacattgcagcaacaccgaagtagaattagtctaaagccgaacgccaatatttccaaagatatcgatatcgtttttttcaaggatagattctaaacgctttggtgaaccataagcaaactgtacaggacatgacagtttactgcgccatcaattcctagtagtttcgatcttacatgtatccatctttattttgattttctctctagccgtcgaaaaaacagttgatgaataaaattcatgcaactagttacagggaaaccttagggctggttcgtttcatcgttaatccatgtggattgggtggtattgaatcagtttaaatccataataagtcaaattccatccaaatatacaccaatacgcatgaaattaaaataaccgaacaatgccttaattggaatgcttaactgaatataaaatggttcaccaaagcgtttcaaaatttcgatttttccctctagcgtcccgtgaatgctgaataactgaatataataatcaagttcggcaaagacttggatcgtttatatgaaataaaatgcaaactacaaacgttaagctagtataatgcagccttgttcaggcttgttcataataaataatgcagcagccttgttcagtcttcagaagagcaaagccttgttcaggaaagggtttcccgtggtcaaggagtagcttgagctcacaccttcctcttcttcttcggcgggctgctagtcttagccttgttgagggggttcttgccgtacttcttctccagctttgaaatgtatgtgatgagcctgcggtgagacttgctgtcgacggacaggatgaagctgagccagcccctcacgtgctcgatctcggaggacttgccgcagaagatgtggtgaatcttggccctgatctccttgtacttctcgcggccgatgccgaccttctcctgagagatcacgaggccggtcaccttcctctgggagcgggggccgctgatgcaggtcttcttgctattaatcacgaggccctcggacgggatgatgctgaacaggaagtccctcgccttgaccaccttcttcatggactgagccgacagggtgaggtcgtccgcgtaccgggtgtagatgaggccgcgggagcccgcgtagccctggatgcggtagtccagcttgctgcagatcaggttcgcgagcttaggggaggacggggcgccctgtggcaggaggttcttgtagcagcatattttcgtgaggacggagctgatcaggcggttgtagccgagggagtggaagacgccgaacaccttgttcgccgtcaggctcgggaagaagtcctccaggtcgatgttcaggatgaagttcgcgccgatgtgaggggtggcattattgaggatagactggtgcttctcgaagccgatgctgaacggggagctggacagcttgtcgaggatgttcctcagcacccagccctgaagagccttcagctccctgctcggctggtagatggtcctcatgcgcttctccgggcccttcttctcgaccgtgtagatcctgtagcggaagtccgcggtgtagatcaggagcctgagcgtctccacggagatgcgggtggccttgctcatgtcgtgaagattattcataacggggagccccagattcctaagcctgaaagtattaaggtactcagcagacttagccatggtttatgcagctactcacgtccctaggaaaggaacgagcgccatgatcagctactagtaaaaccacagtggcgtgaaaagaaaggaagggaacggagttacgggagatggaaataaagatggaaggcgtaggcggggcaaatggcaatgggggaaaaaatcgcattgcaccatttgacgttaatatctccaagaagaaacgcggaagaggaaggctagctcgcatgataaattccataaatgattaaactttatttatatagaacaccattcgtcatcgaaaaccccacgactcagaaaaccaacgcggagttcgtcatctaaaaccccacgaggcccacgactatgtggtaggccacaaaaccccaatcttttcgcacaacagtcgttttacaaaaatattagaaaatatatacatatgaaatggaacacataggtagggatcaacaatcccgctttttcaaataaaccttgtgtccaaactaggaagcaaaagaaaaaaaaaagaaaccgaagtgtgtcaagaagaaatgaccgtgcgagacaaagagaaagagccaagcaacaaccgggcgatggcgatggcgatggcgagggcgagtccttttctaatcgtcgccagacaaggaagacgagaagtcaccgcactagatcccaaacccagaccgcgtcgcacagagaagaactcaacgcgttcgaaagaagagaaaaccccaaaggatcctaaaagagacaaacaaacgtcgcacagagaaccggtgcgcaacgatgggcaacctttcttttgcgtgcgctcagggatgagcggcgaggagagattgcgaaatggccggccgaacaaccgttgggctgcctcgccgtctgcacgacttcctctgtcacgtggttcgccctgcgctctgtatactgttgtgttgccacactggtgctggaggccgccagtgcctgtgtagcgcagggcccaatatataggtgtggaggaaacgattcttcagcaagtcgtcaggcgcggacccaccaggtctttccggcgcaaccatggcaccacctccacacccttggccacgacccacgacccggattggccgctttatctctatggacaatatggaatgcctccgcggtttagggtcggttgtaaaggcattttatgatatagtgtttgggtgtttgggtgaactttatgatatagtgtttgaatactacggttttgacacgattgtaatttttttagtactgcactctacaccaagatttctctcatgaaaactatcacaccagatttaaagataaacctaaatatatttcatatgtgtgtcagaagttttacacatatgattactcagtgtacaaactagtgtcacaaactctattatataagcataatgtctttacaaaaattaactaaataatggaaactaaacaacgattacagtgacgacgaacccgatcacaagatgtggcgacgacaggctcgaactcatcatagtagtcttcctcttggtgacttggtgacttggttatgagtagagatggccaaatgggcggcacggcacggcccggcccgggcacggccaggcacgacacggttagggcacgacccgtttagcccgtttaatagccgtgccgtgccggcacggcactagtgcctaaggccaggcccaagcacggcactaagcctgcttagccgtgccgtgccggcccgtttagcccgtttagcccgtttagcactataccacagaattttagtcagatattcacaaacacagttaaaacatactaaaatagctaatattgaactgtttagtgcaatggctgactcattaaaaacctatttagataaaaactcacccttgtgagaaaaccctatataagaaaaaagagtacaacacacagctaactactcgtgcttggatctaatcatgtataatcgtgcctaaccgtgcctaggggctaatcgtgccgtgcccgtgccggcccagcgtgcctgatgctcggcccaggcacggcactacctatcgggccgtgccggcacgggcccgacactagccgtgtcgtgccgtgcccaggcactacgggccgtgccgtgcttcgggccggcccgtttagcccggcccggctggccatctatagttctgagcaacaaattccgcaagggtaagtacatttatggtgtgtactcagcaaaatttgtagaaaaaagtgcaatgtaaggcttaccaagtaatgtaggtgaagctaatcattacttttaaattttgttggtcaaaattttattagcaattactaaatgtaagtacataaagtattagttaaataaatgatcatagagacaataccaacaataaaatgcatgtctgttttaattcaattttataatttaactatgcgagaggcccgaaccgctcttgacagtacgcacggctcatatatcagttttacactctacagagattgcacatctttacccacaagtcgtatttctcatttgcctcaggttagctagatcattcacctctttataggaggtaggacaggattcactacgagacctttacaaagttgcagtagcatgagaaaacccgctacgatttcaagcagaggtggtataggaatatctcgtctgaaaagctaccatagagcagatcagcccgagaacctctctatacttgagtaactactctccacttgtcccttttgggtaaggttctcacacactaacttctctaattaattagccagaacagtagtcataatagtccttttggttgtactgttttctcaagttgttattccttgttctggttaaataaggtgatcttataatgtataataaataacccaacaataaaaaaccataataaaatattatcatgattcataagtatcaatatcacacaacgatagagatggtcctaaaacatctgacttatatgaaaaatctaatattttaacatagatagcgatcgcgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcatgcgcacccttagcgagaggtttatcattaaggtcaacctctggatgttgtttcggcatcctgcattgaatctgagttactgtctgatttcctggtgaaggtctttgtgctaaacaaccagcacctggggatggtggtgcagttggaggacaggttctataaggcgaatagggctcacacctacttgggaaacccagagaatgaaagtgagatatatccagatttcgtgacaggaaacccgtttcttctgacgtaagggtgcgcacaagtatgtgtgcgctctgtgtttcagagctatgctggaaacagcatagcaagttgaaataaggctagtccgttatcaacttgaaaaagtggcaccgagtcggtgctttttttttcggaccggtacctagcctagacagagaaggaattgaaaatgtgaagcgaaattcatgaaaaaaatgaattttggttccatatgaccccagtaacgggaaagcttgcgcgccagtccacagccgacacgtatggtagcctatggtggtgtcatcgcctatctaggaggtacggaatgctggccaggtcctcttgtcctctctctctcactcatgctgtgctgtttgacatgtctcgatctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccttggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccgggtaggcgatctcgatcaccacacatatatgcatgcacagcacagcccccccaacccaacccactaactaacactaattaatttcaccctcctgcaagcagatctgcttgttgccgctgctgtgctgcgttttacttgcgcttttaccacaagagatctgcttcctttttattatctcctttttctccccctttctctgtgatttcatgtttttttagcagcggcgtttatttaaagccagtagtagccaagctactagctgcagctcctggccttggcctgaggggcatgttatttttattcctgcaatatacctgcgtgcgtgtgtgtatctgtgtgcgcgtaggtgcatggcggtgttcatataaaccggccgggtgtgggtggatccctaactggcacgagacatcctctcagcagatctacgagccctacgctttgcctctttcctccagcttctcgggtagtcgtcgcccgcccccacgcccgccctttcctccatcttctccgggtgtctggagtggccatctttcgtgtgttgggtgggccggggcatgcgcgtgtcagagacacgcacggtcgattgctgctgaggtagctaggggatcgatcgtacgttgtcgctggatggaggaaggtaaagagttaacactgatgtgatctgctgagaggggaaaggggtagtatgttctttccgttttgatccagcgcctgcttctatgaaaatcctgctgcatgcatgcccacgcacacctgttctgctcgatctggtggctaccttcatcttattatctcctgatctatatctcttgctctcgattgctccttaattggcagtgcaaatttcatgtcattttgcttggcagtgcaaatttcaattttattaggcttgctccaaataacatttagatctgcttgagattttcaggaggcctcaacattttaagctgaaagctgaaagcatgataatgaaaatctttctgtttcgcccctagtcgtcttttcacccatcctctcctttgtttcttattgtttttgtgttcttttcttctatattactggtgtttgatgtctaaagagatgtattactctttgtttgttcttaaggtatacgtgggagactatttccggctttgctattttctttgttctcattttatgcgtatgcctcagtgctactcagccatgagtggtcgctcttttgcctttactgatagtatagtatgttgcttgcacgcacttcttgctttgtctttcgcgctgctgtttaaagatcgttttaccttagctatttcttcatatatatgactggatctggactaatataattaaacgtaagtttgtatttcttcacaaaattttcatagaacgcaaacacgcatgaccaattctattttcccccttttttcaagcgctagtctgttcaattcgtttgtagcttgaattattaaaataatacctttcgttgaaaataataatatatataaggtccaaacttcaaatttgctccggggatgtatatgtggttcagagtttcagacttggaacctctccatagcatgttttaagttgaagtttgtttgattcacaaactgttgagatgatgtattatttgagctgtatggctgtatgcatgaacatgcaaaaggccggaacgatatttccatttccaaaaaaaaaagacttggaacctctccattaaacactgcgtcttacaaatttgctgtgatatatggtggacatcttatattatgtgcctttaatttgtgtgacgatatgtatggatctattttatgattttaagtatatgagcattgttttgtagtaggagagtgatcttattccctcgagtttcaactgttatggtttaattctggaaaaaatgttttagtttaacaagaagaaagtgctaaaatgttcaccaccaattcactaggccgggcctgtgagtttgttgggaggcgacttttgttgctttgagctttgtttttttcttttgtcagtgtatttctcttccgtgtatccaataaaactttggccacttcaatcctcttcctgtgctttcgaaaaaatactagggttctattgcgtcagagaactagtctgatttcgtcaaggtatatatattgagccagactttattttgcagaaccgtttgttcatggtggtcgatgttcatacaataaacataaggcaaacggggatctgaaaatttctatcttcatgtaccatacattgatgcttcataaatttatatttttatatattagtttcaagacaaaaaccttgatttaaatgacatctgtgggaaacaaggctcagaaataaagagctacatctacgtcaaaggaactaaagagccatatagctacaacacagagtattcagtagttcttgtaattcttatatataggcatatatattaatcataagtgcatagctacaagatattcacgaatttttacagattatcttcaactttagttgttctaaagatggaagctcccaaataatgttctacaaactgcttctcatgtgacgagagcacaaccactaccggaatttggctctttgccgagtgccatattctttgccgagtgttttatctcgggcactcggcaaagagctctttgtcgagtgccacacaaaaaaccctcggtaaaagaaaacactcggcgaagaagctctttgccgagtgttttatttttgacactcggcaaagagtttctttgtcgagtgtcttttttagacactcggcaaagaacgtgattccggtagtgaacctcctgcgggcttgttcggtaagctaggaatttagccaaaaactgtttcaactcatcgaaggttcaaggctatataaactagctaggcaagcattcctgataggaattgttccagatcatggttcgtgcggaaccgacattcctaacaggaattgtttctagggcatggttcgtgaggaactcgatgacaatgcctaaggccttattccatatagattgaaggggatgtgagtgtattgagatggattttgacttactaactatggatttaaaccgactaaatctcgcccaatccacatggattagcatcaaccgaacaagccctaatgtggttcatttgtaatccacatgaaatcagacttctttgatacaagaaagaatacaataatgttagtaaatagctatatacatatatatacaaacagggcagcccttgcatacaccaatacattcctcatcagcatctttgccattttagattatagacgtcattttcagaaattttgtagtttcatcaagtaagtccttttacatgtaaatttttgtgcagcataacaaaaactttaaaaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgagctctaagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatgtgctgatgcatagctgtgtaccattgttttgggtcatttttctgctctatattatttgtccctttctactggcccatgcctcttaaagcatagctacagactatcgccagtttttcctagccacgtttgaagcctagacagtctagttgtccaatgatgacaatggcgtgtcactgcttgccgagtctgagcagctggtttcttgcatgaatgcgcagccgcgtgcaaataattgtgctgttttgggtgatggcatctattaattggtttacgggatttctgtagattgctatagtttgtgtctagtgtgcttgcattatcttcagcttgtacaggagtgtgtaatggctgaacaggccagcatgttgcttgtccaccatccatatcgctaagattaattattggtggttagtatatggactgacgcactttgtttttgcatcacactacatgacgagaactgtacaaagagttggttattacaagtcgcttatgtcacaggattgtattatatttctgcaatgcaatggctagtttttggagtgtaagagcaagaattgaaaaatgggcagcttgtattactcgtatgctcaagatttatacaacaccatatgtgtgatggatcctacaatgtcatttagatatctataataaatttaggtgctttcatagatactcggtcggagtcggcctaagacttcatcgaaaatagttggcaagcgattccggacacgagccggtaggattcaggttagttgttaatagggtgtgttgaccactaaaaaatatcggagggtccgatcttgaggccggacggtccgcgcagtcgagcaagccactgtcgtccgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgccgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatagttagggcccggtagttctacttctgttcatgtttgtgttagatccgtgtttgtgttagatccgtgctgttagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatctccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctccaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 698 - DNA, 1999 bp, Arabidopsis thaliana;
aaacattatgattgagagtgtacatatacaataagtaattaaacctcaaaaccaaacagttttttttttttttggtcaacaataattagaaatgagaataaactatttaacttataaattctagacccaaaaactcatattttacccttcttggtctcacctaaaaagactttaattcccaaaactcttgcaaacaatggccaaacatagaagattggaaaacaaatttaaatctactttcacttttataaagaataatcaacgaaccaattaagttaaacctacatatattcgtatgtgatcacatatgtgttatattcctcacgttctcttccatttagctaataaccttaattacttcaagaaatcatatatcaaccgaaaactagtaaaataaatatacatactgaaagcgcgcaaaatttttagcaatattttaaaataccctacatcatagtcttaactaattaatctttctgatcaaaatttattttcataatattcataaatacttatggattacctaaaccaggatacttatccctataaatctgtcaatcatcatggattcatggagacatggtcagatatcccacgtccagatacaatgtaacatattgatatactgcggctgattattattttttacattagaacgagtttagatccaaaacaaaattggtattctcaaacaaaaattaaaaattgaatacgaaagtaatagaacaaaacttcaatgttgtcgaatagataggaagcaatagaaaagcgacacgtacatgtccattttaaggtaggagaggcttttctgcggcttgtgaagtaagaaaaagaaaatgatgatagctgctttcgtttcattcattgcagaagaaaccaatgtttccccaatctcacgcgcctcctcctatctaccaccacttggacaaatccccttttcagtattagtttttttttccggacattgtacattcaaaagcattccaagtgtctaataaacataactaaccactccaagatgcaaaatctagctacgaacaaattttaaactatagagatgaactttaaattcgggcattaattagtggaacttgagctattgatgagttttctgactttttgaagcttaattgagttttatatacactatatataggcttgtaataatatggatcaaacaagaaatatataaactacaaattgggaattaggttttaaaacgttatcgttctattttaattcaggcacctttagaatatcaagatccatgcatgtttcaatatttctgttgacaaataaataaagatgtctcaaatatgaagtttgggcaacgtacgtgtagacctaaaagagtcgaaacattggtatctaagtcatatatctagatgtatatggacatggattatataactagacaacgtttgttttaaaaacttaattcatttttcttaattagtagcaactagcaactaactactcatggcaaataatggtgtctgcgtggcacgcacttgggagagaaggtgtgagaatgttttttactttctgtgtaaaagatggaagagagagaaagagtaaagaagtagagagagagatattgtatcaccaaaccctaatgatctctcaccctcacaaattttcttatctttatagcttttatagattcacaaaaacttttcttcagattcacaatctcatcacaacccttcaaaaagagaaaagatctaaagaataaacaagagccctaatatcaaatcacaaccaaaaaaaccaaagaaagctaattaaagttttctctctagctattcctcttcttttcttgttcttgaaaactagggtttacttcaccaaaagataagatctttccccagaaaaagcaatacccaagtcatgtttctgtgtgtctgtatatagataaaacattacataccctaataaggttacacaaatagctataaaagagggaaaataagatagggattttttggggtgaggaaag

SEQ ID NO: 699 - DNA, 857 bp, Arabidopsis thaliana;
tcaacagaatattgcctatggacatcctcaggctcattctcagggactataccaatctcttgaatgtgatcccactttgcaaattgggtaaatcaaacaacttttcttgccttaagacatcaacttaggttataaacagttagcagtttgctttaagcccaacattgtctttgtttcatagaggctttggttaaaactcgtgttgtttagtctaaggattcagcactttgatgtctgaagtatggaaaatcaatatctcagacttgaaaatgtgggtttctattgttgacttcgaaactatgttgttgtggtgttgcaaacagatatagccatccagtgtgctcagagcaaatggctgtgacggtgcaaggtcagtcccaacaaggaaacggctacatccctggctggatgctgtgagcgatacttcttcccccaataaagatcttaagcaagtactggtggggtcttcgtggtgtgatcttagatcttatgcatatgaataataatgttattgcacaagacttttgcttttgtagacacaagtggctatagctgtaatagccttcaacatctctcttctgtttcaggatttgtttgtgcctattgtaattgcttatatatgtatggtttgtataatgtgtgaaatgttaacatcgaccatgtctcatctggtgaagtacttatcctgtctatgcatgatacaaaaagacgtggttagatgctaaccgcaatcgcaaacacagcttgtgacaaaggcatataaactctcaagttaacagtgacattcaacagatcacaatgccaccaagatgtagcttttattttcgattctagtgtacagaacatataattacaat

SEQ ID NO: 700 - DNA, 937 bp, Arabidopsis thaliana;
ctcactcactgatttccattgcttgaaaattgatgatgaactaagatcaatccatgttagtttcaaaacaacagtaactgtggccaacttagttttgaaacaacactaactggtcgaagcaaaaagaaaaaagagtttcatcatatatctgatttgatggactgtttggagttaggaccaaacattatctacaaacaaagacttttctcctaacttgtgattccttcttaaaccctaggggtaatattctattttccaaggatctttagttaaaggcaaatccgggaaattattgtaatcatttggggaaacatataaaagatttgagttagatggaagtgacgattaatccaaacatatatatctctttcttcttatttcccaaattaacagacaaaagtagaatattggcttttaacaccaatataaaaacttgttcacacctaaacacttttgtttactttagggtaagtgtaaaaagccaaccaaatccacctgcactgatttgacgtttacaaacgccgttaagtttgtcaccgtctaaacaaaaacaaagtagaagctaacggagctccgttaataaattgacgaaaagcaaaccaagtttttagctttggtccccctcttttaccaagtgacaattgatttaagcagtgtcttgtaattatacaaccatcgatgtccgttgatttaaacagtgtcttgtaattaaaaaaatcagtttacataaatggaaaatttatcacttagttttcatcaacttctgaacttacctttcatggattaggcaatactttccatttttagtaactcaagtggaccctttacttcttcaactccatctctctctttctatttcacttctttcttctcattatatctcttgtcctctccaccaaatctcttcaacaaaaagattaaacaaagagagaagaat

SEQ ID NO: 701 - DNA, 653 bp, Arabidopsis thaliana;
ttaaaggctaaaaggtttgctggtgccatcattgtctatctaattatttagtaactacttaaaacataaggcatggtgttgctaaaaccttaaactgtcatgtttcttagttatgtattttaaagcctaaagaaatatggattgtgtgatcagtagtgcttaggcttattgtgtgtggaatgttttcaagacttttatcatgtatcgtattattatattgaccactctacttaattatgctacaaatttactcgatttgattttctacttgaatgcatatatattgtctgatgaaatacaaattgaagttgtttccacaaaacgaatagactaccaatcatactattgatttacaaaactaaaaagtaaagacaaatttttatacaagatgtattccgagccaaatgcaacaacttttcgggttgttatgtgtaacccgaaaacaaagatattcaaatattcaccctaatgaagacgttcacggttaccaatattgatcacaagtttggatggtaaggctcttttactaaactatctagcaaaccaaaaatcatcgcaatcagaattatgaattaagagttaggaataaacttttgcctatataaccttcctagaaacttcatagtccggtcaataataagacaggggaactt

SEQ ID NO: 702 - DNA, 2002 bp, Glycine max;
tttcaaagaatttaaaagcttatatatgagaaggtatttatttttgaatctaacggtttgcttataaacatttgtataaaatacttgaatgtaattggatattgcaaaaagacaaacaaaaaaaaagaatttgaccaaaagaaagaaagaaaagaagatgggacatatttacatagggatcatctggattaaggagacttaagagtcgaatttcttaatgaaggcatacttttcttcttgctccaaggagaaaactccacatgatatgaatccaaaatatttttcattgatgcaaaattttcatacatcatagaaaattctagtctttcgtaactaattctatatataacatataaaaaaatactttttagatataaatcaagacaaacgaaaaaccaaagatactaagaaaaacttatcatcatgggctagttgagtttaacacagttgagttgcctaaagtgtttatgagctgcacgattttccgcaaccgcagtgtcgacgacttgtttgccttgttcgtcagaaaagatcgtaaaaagatgaacaagagtgtccatgatgcaaccaagaagaggaatacttgagcaatttgaattaactcgaggagactgaggatcatccatatgctcttgaaagattgtaagagaggatgaataaaagtaaaagtaaagaggtagtggtgtatttatccaaatcctcctaatgcaaagagtgactcgatgtccacatactctttgacgattcaaaaaagtaagttgatctcaaagaataaaaatgccttagctttttcattctttctacgtggaaaattcaaataaatcattcatccacttatttgtgtctagcttctatcttctgcattgtactataagatttattttcgcaattgatgggtaattgttgaatttatggttttatgtgccttagctgattaaaaatatttgcaaaatagatatatgtagataattgataaattttcaatattctctaaagaagaaatccgttttttctaaaatatactataaactttaaggatcataaatcatttagaaatagttactcattctacctttttaaattgttgtggatccaattttacaaattgtaatgtaattgttgtggatctacctctttcacaaagtgtacaagatataggtaggttcagtacatgttataatatgtcttgttataatatctaaaatatttttgtattggtatataatatttaacacattcaaatttagtctataacaaaatcaatactagtatattttatacaacaaataattactgaaaagtttttaaaatgctaaaaaccatataaaactttataaatattttttataacatgctttaagaatttataaatccatatttgtggtatttttgaaaatagagaataaaacaatagtgcttttaaaaggttgtatttttgaaactttcccactgaattaaatattatttaaaatttccagcaccataaaaaacaaaaaaaaaacaaatttatgaatatacgaaaacaccacactaacatctaagttctttcaataacttaaagttaacaccgatgacatattaaagcttcgcaaaatcaccaactatatctccacataatataaataaaattcgaactcttcattcacaagaataaatattaaaaatgtgaataatagagcttttaaaatagaaaggtttgtaaaaatatatactcaacagagtgatctgttgaccgactgttgactttgactaacaaacttcggttacaaagataaacggcaaagatctacaaccgtcagatcatgaactcaattaacaaccgtcagatctcagtggcaattacgtagataataatcaacaccaagggtatttctaaaactacacaaaacgcatttgagcgggtaaattcctcagagcttcttcttcttcgtctccatcgaagctaaaatctcaaaaccctaaaagtctcagaatcaaaagcgaactctatcatcactcaaaa

SEQ ID NO: 703 - DNA, 908 bp, Glycine max;
agtcagtttttggatcaaactttgtagataatcaattcttttgtaaacaaaaccaaattgtatatgtgatttgtttgcctcaatataaatgagtttggctttgtggtttacaagttggttaagagacactgtttacaaagagagggttttaaaaacagaggaaataagaaacagagctttgtgaataaggtctggtttatcaaaccgtcggtccaatccggtttttggaaacattgatgatttgaaaaaaattgtggtgtttcctctatacaaaatgtattaaaatggtttcttaacatgtttaaactcaattgaagaagaataagaacgatcaacaaaaccattcatcttcataactttattcatcatcttcaacaactctgtaactttctccttagttccttcaccacatccaacttgtaacatgacaacaagcttcttaaacgcacctaatctcaacgcttcttcaacttcagacccatcaccacttttacaaaccttccacatcacagaaaccaaatctttcttctcagaaatcttcaaaatcttcttcaccaaaatcggtatcaccagcttgtttcttctcactttctctcttccttctttagtttcacaaatcacgtttaataccgttaacgctttctcgcaaacgctgttttctgaatccactagcatctccactgttatattcacaagatccaattcaagaaaccttgatacggtttcttgatttgtcaagatcatatggtggattgatattaacgagttgacgcatgtagaatcgcgattaatcgatttcatgaacgcttcttggacgccattgatctttgttaacgcgtgaacgtgagttacgttaagctcaagaagctcttttatcaaaaacgcagcgttttgatcaccatttctca

SEQ ID NO: 704 - DNA, 2210 bp, Solanum lycopersicum;
tatcatgtgtatattctgaattatagatatgtagcatgaaaatgacttgtttggcgtgattttcaagaagcataggtctattggaagcagtaggtaaggggacaatgtatggcttcattattgacttcataatctgtgccatttacagccttactctagtttggattatttttagcaccataccattcttaaaaaatacgaaaaaacttaaatatgtcattaaattttaaaataatgataatatatttttgaactattataaattatatgtaactattttttgtgatacttataaaatattggtatttttgttgttaaaaaattataacatatatatcttttatactaacagacatacacgtgttataatcttattcaccgattcaacatttagataaagggcatatatgctctaatttctggacggcaggggcatcaaatatatgacggagggtatatacatatcatttacgataattcgagggtatatttgtcttttccaccttaaattttagaaaagactttccttctgtccttaaatatttgtccacattttctcttttagttattcctaattattttgtcaattttgacagatcaagaaaggacaaatttctttttacctattataccctgaattaattattttgtaaaatgtagaacttcttaaaaatatcaattttttaagtcatcaacttcataattaataagaacaaatgataaaatgactatgtcaaatattaattttttaatacatgtgtcaatttaaaagtatacaagtaattaaaaactgaaaaagtatttgagttcaaagcccacctactattcaaaccatacctctaaaaatcatttttcatatttcaattatcgtcaaaatcatactctccagttttcatttacagtacatgttgaactcaatcattatgaaaagatggaggaggaatgaaaggtcataaaaggggcaaattcattcgtagacacttctatctctaaccttataatatcaagttccataaggaatgaaaggtcataaaaggggcaaattcattcgtatacacatctatctctaaccttataatatcaagttccataagtaattatctataagtaatatgcatggacaaatcttgagggtacttaggaggtatacaatatatatatatatatatatatatatatatatatatatatataatcactgatacattaatttgatgcgcgagatacattaatcgtaaagtgagatatacataacattttatacatgatacactaatctgatgtacattttaaacatgatataccaatctgatgcgcaaaatacattaatatgatgtgcgagatacaataatttgatgtgccgatacattaatctgatgcatgaaaattagagattttgaggatttgtaaaactgatggggaataatgtaaataatcttaagcaccatatttttatatttcaaatcctcgtacacctttgtttggattgttgttacatgtggtatgtattgttagtttaactataatatttgatttgatcattacttaagttttattgtattgcaatttaaattcatccttaggtaaaggcgaggagtctcatttttgtgtaattactgatttattgtgattctgtcgttaccttaatgtatttttcttatttttgtctttacttattatttaataatcttagtttatcttttatcttgtctaaaataatcatacattcactttactcctctctttttttaaggcttgttatccaaataatagacccgtgatattatatagtgataaagaacgatacagtttatttaaacattatattaaataaaataatataacaggatatattataaaacaattcataacacttattttaaatagaacgccagtaaaaattttaaatccaccataaccaataaccaatacgattaaagtgaccaccaaaaagaaaagaaaatgtctattaatcaactagtagtataaaattacaaccaaaaaaaaaaagtggagttaagaacgtgtaacatgtggatttgtctattgttcttttattgtttattattattaatctttatttatatcttgctagctatagtaacttttgtttttttggctataaatagaagactcatttccattggaatttcacaacaaaaactcatcatatctttttatactttttaatatttctcttattcatcatc

SEQ ID NO: 705 - DNA, 1196 bp, Solanum lycopersicum;
aagagttttgagtacacatgaaaatgaagaaagctggagtttgaatgaatcttcaaataaaattgatcattactgtatgttcatttctcctaagtttactgtattttcttttcaaccttacttgttatgtaattctcagtatgttgtgagaataataaaactaattccagctgaaaagtttcaatatattttgcaattaagcaagtttccaatgttaaatttgataagattcaaaaatggattaatgagaagatatggtaattacaggataattcttcattggtaaaaaagtcaagatagcaccttttgtaggtgaaatttaggtgaatcataaattggtttcaccaggtaaatgttgacattttgacatattgtgatgtcatggatgacatcaataagaagaattccctccaataaataggtagctcctaattcatttgtaacacacctctcacttgccttctcatctcctaaggcatttgttcttctttctttcttatagtatttcacttgtactcttttggagtgaaataaatattgattggttgtgtccgaggagtaggcaaaagaaaacaaaagtttaccgaacctcgttaatttctgatgttttttttgttgttgtctcatttactatttataagctacctttagatatagtagttgtaattccatcactctctatatatttggcttccacaacatccgatactccttagtatcataattagttaaagtcaattataagtgtgaccaagtttttaggaaaaatataaatgtttttaagttgtttttcaaaagaaagtagtttttctagtatttttggaaccttggtcaagcacaaacttttgagtattgataaaagtgtgtttcaaatttattaaactcaaataatgctctacaacttgcttgagatttctccctgaggaattaaagtaattaataaatcaatatttagaaattaaaacaatcaataaataaatagttaaaaatagtgtcggtataaagaatagtattttataaagaaatattaaatttatataacaaccgtattttaaaaaaaagttcttgttcttgatatccttttttttcttatttaatttattttacttcaaaaataaagattacaatttgaacataaatatagtacatatttacaaaataggaagtattttgaggaatgatcgctttaaaataaa

SEQ ID NO: 706 - DNA, 2136 bp, Solanum lycopersicum;
caaagcacgtgcggtgaagctaaatatttaaataactttaaagtaactttcaattaatattagtttgaattaaaaaaaataatgaattagtcatgagatttgcgtactcttacttttgaagagtgtgttatcactcttataataggtaaaagggaaaagggtctgatatacccctcaactttgtcatttggagctgatatacccctcgttataaaagtggctcatatatgcccttaccgctatataaacggctcacatatacccctgccgttacaaaatggctcacatatacccttcatttaacggaagttaaaacattagttttaaatttatatttattacttctaattttttaaaaaaaattatttaggggtatatatgattcttctatcaaagttcaaggtttattgtaatttttttcatacataaattattttttgacttcttttattatagttatttgaatttcttattcttattttgttttttttctttcattccttagtttaaagaataaaaaattaaactatttttttgtgtgtattgtaatttaatttcgtattcgaagaaaaaatttggtcatctataataagttttacaagaatattagtgaaacataaataaatttgattatcaaaataataattataaattaatcattgaaacaaaaaaagtcaaaaaaatatgtttgacgaggattaaattactcatatgggattatattttttagaaaaattattatttttcatttccgttagaggaaaatggtatatgtgagtcatttgtttacaagtaggggtatatatgagtcactttcataacaaggggtatatcagctctaaatgacaaagttgaggggtatatcagacccttttccctatgtaaaatctaaaattaagtttgaactcacataaaattatataggccgtaacctacttaacccattgtcatcactaattatatagagatcttgatttgatatattaaaagtaaatgcatcacatattttttttaaaaattatttatttgtaaaaataaggtcgacaaatactgtgaaatcaatgtgaaaaaggttttgatcgttgagtgtatctttaactatggtgatgcacaacgtaacgaaatcattttcattaccaatattatgaatttttacattatatataaaataagatatataactaatatccatatattatattacatatataaattaaaaatatataacgaacaaaaatactacaaaattaatggaatacactctatgaatccagcatacacaaatagagcctctacgtaagccagttgttatctaatctgtttagtcactatgacatcagataagatatctgtttagggtacccgtttacacatcagcttttaaggtttcctacttaccaaacacttctccttcaccaaattgtttctccaatctcattcaaacaaacacacaactaggtggttcgaacaaactcaataatttttttttaaaaaaaatttatatttatactaaaaattaaataaatatacatgtacatttgtttcttaactcataacaaaattaattaacgactcagtgggatcgtgaaaatgttttttacggctaaagttatgaatttaaaccatagtatccacaaaaagttaagtttccattttttttcccaaagaaaatttaaaataacaaactcttaatttcaaaatatggtgcacaaaatataaggggaaagggttaaattgagataatccggtgtcattttaaagcgaacaaaattgattttttctaaaactaaaaatcaagaaacaaaatagaaacatatcaaataagacaacaaaagtgtgtaacgtgacaatgtgatataatacgaaataccctaggaataattgaacacataaaattcactataaaaggacaatgtcataattaatttttgtaaataaaatattcaccactttacatgatacgtaattggtatttggtacaaaatttgagtaatagtaagataaatgtagtagtagtgtggtacttactatggttatgtctatatatacatattgcatatgtatatataaaaagattgaaacaaagaaaaaaggggttttgtgcttttgtaagtttgagaaagaggaaaaagaaaa

SEQ ID NO: 707 - DNA, 1195 bp, Solanum lycopersicum;
tcataacattattataaatatgctcaatggttttcctatcatcataaacattgaatatctcctaatttctgtatgttgtttgagaaaatgtttcatcctggacctaacggggatccataagacaatcccgttattgttagtaaatcataaactagatttctttgagtgcttaaccagttgacttatgttcctccatcttctattctttagttgttgctatgtttgagtctaacgtcacaatgaacagagacaagtctagtgtacaatgtacactagccggcatgctctcgagctatagttccttaggctcgtcccctcttatgagtggttctcacttgtgtgaaactggcaatagaacgagctagtcacagtttagctatgtaattagacagtagatgttatcttgatatttcaatttctacggataaatcttaatcctgggattccacagattcacatatagtagttgaaactctatagtatgagtattattattatttgttaatatatttctggttcttactcactgtttaatcaatgcaattacagcctcccccaaaacaaaatccaaaaaccaactccctcatcaaggctcgacaaacaacccacaacggtggtatgttgtcagtaatatttaaggtggaatactattgagatgtaatggcgtaagtatacaactcgaccctagttggtgtttggacaaaatgataattacactcgggataatatcaccttaaatagcaacagaaagaaagagagtaacaagacatcatctaggaaaaacaaaagttctttaactaaacaatttagagctacataaagacgaagggaatactttgtagaagagcagtatttattaatcggaaatatctgcctttataggcttacaaacgcaggaagataatatctatcatgattcctactagactagaaactaagaaaggaccataaacaatatcaacctaacaaagactctttcaactctagtaaaagacttattcaactcacagtaaatgatttattttacgcggtgacttagactcttttttaaatcaattgtcaacactcccccattgattcaaaatcacatacgttaaggcataacagaaagtacttgtgtttgtgaaaaactaaagttgattttttggaagtacaaaaaatatcatagatttttagtagaactttctagagtttt

SEQ ID NO: 708 - DNA, 1920 bp, Solanum lycopersicum;
tacttgggcattatcccttgtttttatgataaatatatgcttctattaaaaaaatacatttttataaatacaatttttatttatggatatattataagttgaatttatttgcataattattatgtttttatattttgatttctcttacaatgttcattccactactaaattacatatttttcattaaatagtttattactcacttaaaattatatttatctataactaaaatttagataactttagttataaatttttttatactttaataaacttagaatgaaattatttttaagctaaataagatgaaagttatttttacgctaaataagatgaaagaatcttatttttatgttaaataagatgaatattttattttaaagctaaataagatgaaagtttaagttaaatgagatgaacatttaaattttaatatatacgacataatcatggcaatacacacaaaaaaaatatttaagctaaataagaggtaatttttatttgtaagaatgaataactaaatcttgtacaaaaaaaaaaaactaaataaggtgagggtatttttgtaaacaaccaacaacttattctcaaaaaaaataaataataaatattaatttaaatatgacaaaccaaacaaacaactaatccctatacaacatattccagcataactagtattcaaatcaaacaacccctctatgaaatccataagacaagaaataaaacaaaattgcaaaacaatcaatagattaaggtctaataagacataagtagataagtgaatcgttgaagaagacattgaattttgatatagtacaactccatacctttttatggttattcatgttaatcttagggtattcgatataactttacaagtaaaatctgtaaaagatatacattattcttatctttatttagaaagattatttttgattgactctcaaatcaaaaatagtgtaatcgagtatgatttttcaaaaaaacaaaaaaacatcaatataacaatatgagcgaaataaactaagtaataggcattgtaaaaaaggaagaaaaagatgcttatgacttatctccgttactgaattggttttcctcttctccctaataagcaaagagccaaagactaatattgaaatgagttatttcctcatatgatattcgacattaatcctttcatcatcaattagttttttcgaatgaagttagactcaaaatcccttgtgaaactttcaaaaaattaggtttatgagttgagttggtttcagaatgctaaaaataaaatgcataatacatatattgtatcctaaatttggcttcaaattttaactttgacctctaactttcataatgcacaaacaaacactttgactatctaactttcaaataaataaacacatgagtcttacatgacaaaaatatacatacgacaccacgtaggacgaaaaatgacatgtaagacatgtgtgtctatttgttcaattttatacaagtttaactgtttaagtgtctacttgtgcacacccaaagtggaagggcataaatgttatttgaagtcaagttaaagccatacaaaataaaaattgaattatgtcttatttaagatggataagtagtttagctaaataaatttttgttagtaagttttccatttctataaatttacagtgaagaagtgagttatttgcttacgcatgatatgtacgtaatatccactaatacaccgacgcgtgtccagccaatttagtacacgcctttgttctttcactgatggaccgcacaaatgagaagcaaaagctccaacaaactaaccaagcgcgtgtatcccagacaacgaatagttgttgtgcgtgtactccacgcgcatcaacagaagcgtaagactagtccctataatgcattggctaaatacatgaaact

SEQ ID NO: 709 - DNA, 1506 bp, Solanum lycopersicum;
tgaaaaagtagtggaaataagaaccaaccctaaagctctaaggtatctaaatttggagtacctaagcaaatcctaaagttaaaacaatgaatccctaaagaagataggaagaaatgccatagataaaaacaacccatgttcactttttctctctctaaacattgaaattcaaccaaaacaaaaaacaaaagttgataagaatcctttctttctttctttgtgtgtgtgtgtgtctagctagggtttgcatttctttcacaattttggttgtttcagtaggagagaaaagaggatctaagagttagccaagagaagaaattagtgagaaaataaagtagaaaaagatcatcagaggaaggagggatgaaaaagtcctttatcttcagctttgcataaaagcatatgaagtatatttctataataataaaggaaaactccagtacctttattttcagcaaaataccctaattaaggtacagagaagatgtcaaaattttttaccttcattcaaaatgacttctttagttgaagtaggaacaacatttcacaatcagcattccaatatcctccgctcttcactattatttttaatctctcacaccaaacgagtcctgcccaatccttatatctcctgctctcaccccacaaccccaacccccacaaattccccgtatttgtctagctagataatatgtaatattttattcttttagaataatatatattttttttcttataatttaccatatcgaacacaagaataaaaagtggagaatcccacttatttttcaaaaaaacatttttgaaaaactaatagtatatgataagttcaaaacttcctaccaaacaacacttaaaaatattccttggcaaagttttccagaatcgatcgggtcatttaaacgcttgttggaaagtcgtagattgaaacttttatctgtataacattgtaactctatatgaacaagaaaggaaatattagtcgcatgatatcttttaataaataattactttttatttattattatttataacagtacataataatgatatgataaatctgcaatatattaaaagtgaattatgtatgcaatatatgtgtattgtaactgttttaaaatatattatgcttgtttgttaagaaattaacacattttactaaaatatatgataaatgtattatccatcaataaaacttgtaatatatatgttttataaattactatatttgtaacatgtattaaaactgtgataaaagtattatccatcaataaaatttatattataagtgttttactgtaatatgtattaaactatattataaatatattaaatgtgatcaagtgaataaaaatattattgctataaatgataaatattcttttatgatattttaggtaagtttcctaagatgaaattagtcattgtcaatcacatatcaacccatttgtatcgtgattaggcctagaacacaaacttagaaataatgttctcagttatcaaagg

SEQ ID NO: 710 - DNA, 3207 bp, Glycine max derived;
aagcttccataaatagaagcttccataaatagaagcttccataaatagaagcttttaccatatatagaaataagcttttaccatatatagaaataagcttttaccatatatagaaataagcttgcctctactctagtctagagtcactgaatccctttgatcattaggataaagtcaacaagacttacaagagtcatggttttgatttgagctaaaataatttccatgtggcaagaaatttctttcatggagccttggaaagcaagaaatttcttcctaacgttgtttgaacactagcacggtcccatacacacatattaaaataattcattctctagaagcaagcagaaactcaaaattttaaatgattatttcgtgggaagtttgaaattttcacaagttcatgcgataagaaaacatttaattaaggtatttatctctaatgacagattcaagagggagacagcttgtcaaatgaacagttatttgatgcaagtctctttcattgcccgaattatttgtgatgatattgacagaaaatgcagaactttttttgggcatcatctattcatcttttggccaaaaaaattgtcaatctaattctgtggatcagtggatggtcttggaattaggcaagctagatagagacacgaattcagcttttcttgtgtgaaagttgatggaagttactaactcaaccaaatgctctttggatttccattgtcaaagccacagaaagagtgtgcttgattaaagcgtgagtttggttgatttattgaaaaaatactacacaaaattatttgttttatgttggttttagaaattattatacaaaaaaataaaatgaaaaaaatgaaaaaaatttaaatattcattactgctcaaattatggaacaaatttttatctcatgagtcatcatgaaacaattttttatctcatgaagtgcatatgctggagttggttcccgtgggttgttgtattttgcttaatatggattgttccctggactagttcatttgtagtttttgtttgtttggggccttgggccattcttatcactaaaacacacacatgcacgcttaccaacaactcatttgatttcttatgacaattttttttctaatcacgataataataccaaatattcataatcaaaaaagttaagattcaaaccttatattatttagttaagaaatataggtctttatcatttgtgttaatcggttattattttttttctttcatttaattttaaaatattcatctccttaaaaaaattccaatgaccctaaaggagggttagtatacaactaaaactaaccaagtccctttttttaaaaaaaaatacattaattaaatatctctatctcagaggctgtttgattgagtcaaaagagaataaaaaataagtaaaataaacagtaaaattttataaaatccatatttttattctcaatttaaattttcatttatttttacctttatttttttttccactctaccaaacatgtacttagatttgaccataaaagaactcgagcaaacagaaattcgaccattcacttcatttactcattgactagtttctcaccgtcgatgataaatcatcaacgctccccgtgatcccctccaccgttacaaacttgtgcccctacctacactaaccccaaatgcaattcaacttttaaaaggcgccaacactttaactgaatcagtttgttcagttaaagcgctctctctctctctctgttcttcctcttcgcacaagcttccataaatagaagcttccataaatagaagcttccataaatagaagcttttaccatatatagaaataagcttttaccatatatagaaataagcttttaccatatatagaaataagcttgaaaacacgatgcgacagagatcgtaatcgaagccaaaaccaattttccataatcataatcaacactgtctttcgctctcatcgaagcctgcaagaagcgtaaacggttgccgaagtttttcaggttcaactcgttcggcgaccctggtgttgttccaattgcacgttcgggtcccttccgcgataacgttcgcgttttccttcaagaagctggcgatctcgaagactacactgtctccgggaaccccctctggtgcattcttctcatccacgacaactcgtacgctctggctcctctttacaccatcgaagaacacgtcgaccactcttcgcaccccttctgcgatcactgccgctgcgtaggttcgtttccgaatttcgccttcttgggtttggtttgattgttgattcttgaaatggggttgcttcaagtttgggttttttgcttgatttttgaaatgggtctgaataatgtgattgcgttttgttgcttgtttctgaaaaggttttttttttacgtgttttgtggttttattttcgtcctgattgagttaatctgtttcgggtattttgatacgggtgatgatgtgggctgtttccaattttggatttttttctatagtagggtattgttgagaagggttgcttagtggtttgggttgtttgagaaaatgtgtattttaatttttgtttatcattttgaattacaaaacggatacttttttttatttaagttatggtttttgaagagtttgaaaaggaaaaatacttttcattgatttctgattatagactatagagacttttgaaaatagaaagaatgagaaaaaatgtgacatttttgtgattggaaatgaaaacagaagcattttcttctgacaagttttccaaaaatggctgtggagtatagtatagggactagggttatcattgatactgataatgataccaatatgcggctttgtttggttaaaagtttgtaaaggaaaaaacacttcccattgatcatattattgtttggtatacagacttttgaaaatagaaacagtgaatacatgaattctatgattagaaatgaaaacagaaacatttttttatgactagtattccaaaaatgttgatttattatgaaaagggttggtaggaagtttgatgattttgaattttggataatgggttttagaactactgatgtcgatattaatatttgactttgtttggtcaataattgataggttggagtggacattgtatttttacaacaattaccaacaacaacaaacaacaaacaacattacaattactatttacataaacc

SEQ ID NO: 711 - DNA, 123 bp, Arabidopsis thaliana derived;
aagcttccataaatagaagcttccataaatagaagcttccataaatagaagcttttaccatatatagaaataagcttttaccatatatagaaataagcttttaccatatatagaaataagctt

SEQ ID NO: 712 - DNA, 123 bp, Arabidopsis thaliana derived;; identical to SEQ ID NO: 711

SEQ ID NO: 713 - DNA, 68 bp, tobamovirus derived;
gtatttttacaacaattaccaacaacaacaaacaacaaacaacattacaattactatttacataaacc

SEQ ID NO: 714 - DNA, 20 bp, Artificial Sequence
  synthesized vector component
ggaaaagttgtagactgaga

SEQ ID NO: 715 - DNA, 20 bp, Artificial sequence
  synthesized vector component
atggactatgttcttaatca

SEQ ID NO: 716 - DNA, 20 bp, Artificial Sequence
  synthesized vector component
gctgcggttgcatgggaagc

SEQ ID NO: 717 - DNA, 2000 bp, Zea mays
aacgagaaacacggcgcggtgaacgcttgtgaggagccctgggccttggagctggacaaccaatcacagagatagtgttgacgaggcaacctgcagatagcaccattttatcggaggagccgtaccggtggtgaggatggaggtgcgatggcgtactatgcgacgtgtgtactaccacctgcatgcggcgaggagaggggaaagggcacacaacagaagcgcacaagcggatggcgtcaaacaggcacgctgtactgtacgcagcggtagtagccagtactagctagctgggtctctgcatgcatccatcggcatcggcgcgcggcgcccgcgacggcgacggcgacggaggcgagcgagatcgatcgagtcggtatgtggttgcattcgtccggcccggagagaaagacaaggagaagaagcgcggcacagggcgcggtgtctgtgtatgtctctgtctcgggtcaggtcgatcaggtacgtcgatcgacgatcagggttcagggtaggtaggtggtggtccacgtacgtcgtcgtcctcgacctcgatctaccacaaagcaatgagaaagcaagggggagtagtagtgcgcggcgcactggatcccgtacgcgtgcatgctaatgctatgctgtgcgcacacgcaccgggccgtacgtggtcacgcacgccgcgcggccgggacatgccatatggcctttgtcccgcgcaggctctctggcagtctggctcgaggtggtcgaggccggggcgggcgggcgggcggcggcggcgggcgagctgggtgtcgcggtcgcgggcggacagaggggcggctgtgctgtgtgtgtgtgttccgcgcctggccgctgtgtgtcctggcgactggcgtggcggctgacgaattcgcgggacgtggcgttgtcggctccgtgtcggcggccgaaccaccacgaatcactgacgtatctcgtctcctctctcctctagactcccacgatacggccaacgaagtgtatgtacatatatacccatggtcatatggcaacaaacgccaacgccagcagagcactgcccggcggcctttttcccatctctctctctctctctgatggcctgatggggtgtgcatgcctgactgactgatagatagatagatggtcaggtccgtctgatcctcatcggcctagctcaccccacgcgaaaaaagccactgctggctggcgcccagttgcgcttgcaacagtcactttaacgagccccgtccttgcgtttgccctcctcgctctgcccctgccgccgctgcgtggtggtgctggtgcatgaggcaggcgtcgtactagtgcatgcaatgcaaccgtaggagtgcgttgcgtaccctggtctgtccctgcggcctggcctgccgcccttgttcgttgcggatgcggggggtgccgggtgggtactgtactgtactactgggtagagagaagtagatatagatagatagagagagagagaggtcggtcaccccgggcgcgggacacagcctctgcgaaaaagcgatccatgtcgcgcctagctttgacccggaacggatcccccaaccaggaaccagcagagcaggagggccaggccaccacctctcgccattccattcccggtcctagctagtcctgttctgttcctgtagcagtagctacggtactacgagtcctcctcgacgtcccaggcactactccactccacgcagcagcaggcagcgagcatctctcgaccagatgcatacaagctacaccctcctcggctccgatcctacccatgccggcccaggcggcctataaaagcgcacccccggcccgtcttcctcccactgcatgcccattgcccccccggccttcgccgtgccaacgacacacctcatcaccggccggaacattccacgaccgaagaaaccagtccctagctagtccacgcacgaccaacaaggcaggcgagcgacgacagtccaaagcctccaagaagaagaagaacgaag

SEQ ID NO: 718 - DNA, 1000 bp, Zea mays
tcgcgccgccgccgtcgtcgtcgtcgatcggccactgcaacagtgtgtgtgtgtgggtgtccatctccgtgcatgcgatcgatcgctgccccttagaccttagttagttactcacttactaccttagcttgcgttttaatgtaacctctactaagctagctagctcttgttctgttccgtgcccatgcatgagagagatcgagtaatgctgcaatcgcctgctgcaattaatgcagcagcgcacgacgtcgccgatatatgatggtgcatcgattattgcactccgatccatggatatcatcgatcttaaccggacgtggacgtacggtgccccggccggtgcaggcagatcgaggagggcggcggccggcgatgcccccggctgaggtcacagagcagcagccgggggccagtcagcagccttgtaaaagcgtacgtacgtacgtacgtcgtcgagacatcaacgacgtacggggacgcaacgcaacgcaaccagccaaaacgggatcgttcgaactagagcaagacgtacgtacggcttttgatgagctggcggtgttagactgttagacataaaaaaatacataatactataataaacatacaagctatccatggtttctagctttatgcatgttggggctgcactaatgaccatagtaattcgctcatcaagtgttgtgaggtaccatggaaacttcaaactacgtacagttagcaaatatggaccaaacacaatgcacaaaattttacgtgaaaagactttataggaagaaaaaacacgagcgtcaatcgtcaatcttcattatacgatgagagcttatagaacatagaaaataccttctcgtgcgacttataagttgtatatatatacgacggacaaactatagtctaatatgaaaataaatccactaattgatataacccgacctgcacatgtgcctccagacgtcctcgcaagactcgcgctaaaattcacacgcaagactcgcgctagaat

SEQ ID NO: 719 - DNA, 2000 bp, Zea mays
gatatattagcttactcagaaacacttagtttttatcatattttctttgatttttataaaactttcaatttttgaattttgaacaaaattttaaaacttggctagaaaaccgttcttggttcgggccaggaacaagaaatcagtcgatttctcgtggtttttgaacggtttttaaaatcctctagatgtaacttggtcggcccaccgaaaactaggttagatcaaaccatatgttgacatggcgtgccatgttagagtcacttgagttcccaaatttagtatattgtatcacttaagtcccgaactttcatatgttagcgcttttatcaaacacgtatgcatgagtaattgagaatgtgatccatactgtaacgtcccagccacttcagagcgagctgtagttacttggtgtaacacaccatcccccacaaaccaagttttttctctcactcgtgcgctgcgaaataccttttgcacactttatgctcactcgtgcgtacgagggaaaacttttctataggtcacttatcccaaatcttttaagatcggtcttagaagaaggtcctggtataaatattttatcaatcatattaagaattgggcgaggatgccacacatacttcgacctataaatgtatatatatgcaatttacgtggtatcaattttttgggttaaagtttgggtcgtttttaaaatgtatgcaaatttgttgtttcatataaaaacaggggtaagatcagaaattaactagaaaagtagagacgaatccgcatgagcaaaatgtccatttgaagattaattacatcgtcaaatcacaatgaattaaaacatacttaaaaaactggggcactatctaaacaattttaaaaataaagcaacttcaccgccagctggcactagtcttctagtagcaaggacatgggcacaaaacccgctgaacatctccctcccacggtcccacctggccatccatgacccatccgggcatccgcctataaagttgcgagtctcctggcactggcacctagtgctgcaacttgggccgtgccgtgccggcccggcacgaacccaccgtgcttcgggccttagttagtcgggcctaacaagcacgaaataaaatcgggccgtgctttaccgggcctggtgagtagaaataaggcccagcacggccctaaagcacggcgggcttccatcgggccgtgctgacccaggcacggcacgcagcacacagaggacgcagagtccaagacgcgacgcagacggagaaggtgtcgccgtggacgctgcgcctgcggctgcgcagtgcgtgcgctccagcagtccagctcgtggacgctgcggactgcggctgcgctccagcgcccagcgcccagcggtctccagaagtccagccgagcggctgcgcaggatctcatccgacatccgctgctggtcgtcgggagtacgagagaaagaaaggcgttggccgtcgggagctcgtgcactcatccacatccactgttggccgctgggcgtaggagcaggccgctgggcgtaggagcaggcgagcagcaagctgggcggctgggcgtgtagtagatgaatggattgcggcggccggtggagcgaagtgataggaaacaggaaaccctaatcgcgtgcggtagccggtagactgagtgagcctgtgactgggtgtgcggtggagaaaacgtgctgtttcgtgccgggccggcacgaacccggcccacagcgacgtgccgggcctcatagcacgacgggccaacatttggagcacggcccagcacgcgattcgtgccgtgctagcccgtttttaaatcagccgtgtcgggccgtgcttttttcattttttgcgggccgtgctcgggccggcccattgggcacggcccaaactttcaggactactggcaccaaccactcgcattcgtcactcgtccctctcccctctctcccccaaggccccaacccacttgagcgagccctagagaaggcaaaagcc

SEQ ID NO: 720 - DNA, 1000 bp, Zea mays
ccatcgtcaccaagctacgtacgtgtctacatacaggatcgagatttgcagtcactagcctcaagtgattggatcatgcatgtgattagctctagtcttgatgtgatcatgcatgtgatacctggtgcccaaagtactacgtttctgttctacacttctacccagtagcaacttcactgtgttggatcagtcacattatatgatttctgaaattagccagcagtatactccattgtgttggatcagtcatatcataagatttctgatattagcctttcattccttctgtttttcgctgttgtttctaaaaccatttatttcacatatatatgtttaatatgttaggaatttaggcattttcataacatgcacaaaaataagtaacagtgtgtaccctgcggagagaccaatggtgcaaatcacatgtggctccatttacactagacatctcgtgaaggttgatgttcatcagaattcgatgaaggttgatgttcatcgtgcagtcccgcgaacagccacaaggaagaagacgaacaggttcccgcgaacaaatcaatgtcaccaacgagtcgatgtcgatcaagtagttatgctctatgctccctaaaaacctgatcggtcgcatatctcaaacaggatctcttacaacgatgatggtttcgatggcctacttactccatgtcttatgtgtgcaagaacacagggccggaaaagcagaacacaacgtagcagtggatagctctagtggtgttacgtgtgtccttggatgagaggtcgcacctgttcttatagacaccaggagcccctttagcttccaggttaatgccataaaagtgccatcaaatgacggtaactcccgaccatcaacatacataaattactagccatgaaaggaccatcaaaacagtaacttctaaccatcaaaggcatgagttactagtcatgaaaggatgaccatcaagataaaaaggtcatcaagacagtaactgttgaacaccaa

SEQ ID NO: 721 - DNA, 2000 bp, Zea mays
atcactcacacatcaatctcgcgcacttgttcgacattctagtgatttgagctccgttctagtgtgctagtcttttgagctcaagtctgggtcttgtgtgtgcgtattcgctgtgatctttgtgttgtgtgtgagttgctaatccctcccttgctctgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccactgtgtcatctctgtgattggattcttgtggttattgtgttttgactcctctctagccacttggtataaactgtgctaacgcctaatcaagttttgtggctataagtttaagtttttacaggatcacctattcacccccccccccctctaggtgctctcaaaggtccatcactgttgcctgaccgtcggccatgcactagagtagaaaattgggccaaaaccatcaggcccccgccgcactcatcttgttcattgagcggaccactgtaattgcttctttgttagataacaatcctattagattgtcataagcatagggtctcccattataaatttcttttatgttgaaggtccatgttgaggtgcctggttctcccatcatcttggaggaatagtttgtgatgtgttgcttccaatatgcaacaatttctttgatgtgttggtggagacaagattggcataattctctgacctgcatttctgtgttagacagtatcctatattcttctaggaagtcaagcattagaatgataaacttgcggttgggtacaaaaagtggaggcgccaacctttgctgcagctctggtgttctttgaggcagcttgctaggcgagcaacgacatcaacaaaattggttatagtttgccatgatgggagtatggccataagggagtcttggtttttgagccaagcattttcaaataggatgactatagactttgggattgtggtgccatggttgcaaaaatggatttatggccaaacatggttctgaacgaagagttaagtgaggcagatggatatgaagagttgatgtcctcatttgtgaaggcacgatcaagtcttgcaagagtttgagtgcgacgtttgttagtccaggcatagagacaatcaagtagaggtagctcgacaagtcctagctcatggacaatatcattaaacatgttgcaaagctgatgattcgtcattatttttctcattagcctcccttacaagattgaagtctccaatgaggatccatggacccacaatgttagagcgaatgtctaccaagatgttgaggaagttttgagtgcacatgttactttgaggtggttgccatgcttcgatctataaatgtatatgcatgttgtgtcatggcggtatcaactttttgggttcaaaatttgtctcgttttttgaaatgtatgcaaatcttgttgagttaaacagggataagatcacaaagtcaatagaaaattagagacaaatccacatgagcaaaatgtccatttgaagatgaattacggagtcaaatccatttaccacggcagaacgaaaaccgactctagtacgtttaaaaaaaaaacaggagcaatatcaaaataattttttttttaaaaaaaaagcaaattcaccgccagctggcgctgaggcttctaggacatggggcacaaaacccactgaactgcctgaacatctccctcccacccatccggccatccgcctataaaaagttgcgagtctcctggctggcaccaaccactcgcactggcatagcatctggtctcgtctctctccgatccctctcctctccctccccctagccactacccacttgagcgagccctaggccctagcaggcgaaagcc

SEQ ID NO: 722 - DNA, 1000 bp, Zea mays; identical to SEQ ID NO: 720

SEQ ID NO: 723 - DNA, 2000 bp, Zea mays
ttgaaaggggttgagtgcaactctcatccattggaacgccacaacgtgaaagtaggcaagtactacttggccgaaccacgggataaaaatcacgtgtctcttgtgtgctttctatttgattatctgtgttcacaagaactaacttcaagctacttaaccgttctaactttcataatcaagttttgtagctattagtttttgatttttacaggatcacctattcaccctcctctaggtgctctcaatgccacattgacattgctaaggaaggattccatcgacagcataactgcccgcaggcacatactaggaagcaaagtagtagtgctacgtgtgggaccctgataagacgacgagttgacaaggagacaaggtggtgcttgcagtgggcgggttaggtcactcactaaacgaccactcgatgattgaaggagtgagtaagccgcgagtgagctagtgctagtggatggaatcaaacgagtcaagtgggagtgaactgagcagtggagtgtggagaaaaagttagatcaaaacatgcttttcgttagatttagttcctgtttattttaatttaggtataagaggttataaagctgaggtgtggccataacccatcgcttgtgtccgtcctgagctcataccaaagtttggttgacctctttcagagactatgtgagacaaccatcatcttccaatacacagaatgacagtaaacatggaatgtgacataagctaaacttgagcgaggagaaccaaacacctccttcgtgacttctgtatgcgatcttggatttgaaccaccgatgggacctaccaagctataagcctataacctttgttggattgacaatatattccatgattgatcctcagaggaaggccattacgtttacatttagctgccaggcatatagatgtacgaagataaagccgttctttctgctatttcagcactactacttgctcttctgtattcgtaggcagggttcagcgcagcaaccgaaagcagaaacctgccactgcctcggcgatcctttgggtccggggaacacgacgcgggagagcgtcatctggcttttgggccgccgggatgaaggcgtgcgggccaggccaggccaaccagccaacaaactgtgccgatggatagaaaggaatggagcccgtcagactactagacttggccgaagcagaacgcaacaaccttcctcgtcgtctttttatttcgtgcaaagacccttgtggtatctcgttttcgcaacggacgccccgctgcgctgcgttttctgatacaccacaccgcaccactttttttttttttcggaaggcgttgtgcgacatggaggagaggggcttttggctaaagagccagcagggcgccgggggcggccggcgaagcagcagaagggaacaggcgcaccacgggactgggagagagagagagagagagagagagaaagaaaaaaaaagcagcaggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcgtccgaccccgccacagaaggccttccagaaccctccgacccctcacctccgccccgctccactctcctcctcctcccgggccggccgactccg

SEQ ID NO: 724 - DNA, 2096 bp, Zea mays
ggttgcttggtgactaccatcattctactcgcatcgcttttgtggaatttgtgatggttagctagcaaaccttcttcatatttgtgcatttattttgagggaaatactttgcgcagaaattgcatgcagtgtgcggtttaaatatgtttttagcggtttaaaaatgataagaatacgctgcttgagattcgagtggatcatgtttggttggtcagtgcctccaagtgaaggtctgctgttcaaatgtctaagtctgcgtgctaatctacgctgactgtctaagactgagcctttttagtggtcctaactctggtagaaatgttaatacccgcgccttgtcactgtgttcctttttcttctaatttaagacatttcccagtagcttgtgaaggcaggggctcaattcaatgtatttgtaaaaatctgctgggcccccttttgttgtaacataactgttacctctctattttttgtttcaagaaacaaaccccgatggtaagagacatttgcttcttaatatttcaggcagaaagtgctaccgctgccctgaactgcagtggcgtgatactgggatccttgccaataaggtaaaaactctgaccattagacacactcactctgcagtggtattactggacactgtatataacagaggcggcctactgctgcatctcgctgtttttattttcagggtgagcccctcgaagactcccgtgcgtccccgtgcgcctcgccagctgatgcactagaggtgtcctaggtacaggaggtgcggaaggcactgcttatatatcatcatcatatatatataatagagaatagacatatatgaaagaggggaggggaaaagtggcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcgggggggtctgcctgatgctcttgtccttgatgcaacaacaggcggaaaactcctggacttttaccctgctgttcagttgtttgctgctgtgtcctggttgctactgaaacaaactggttaaaaaaaacttgggtattggagactatgtgccctgcctgttggtttggttgctactgtctgtggtttttcttgctcctgtggcggctggttcgatgcccgtggcttttgtctgtttgcagtcgttctgtgacctgatacaatcatgtgctgtgttcttctgggctctggctggctgcacacagctgccaacgactccatctgcagcacggccggccgggttgctgagaacggaaggacaaagttgatgccggctggtgtagtgctcctgccattttgtatgtatttttggagtgctgcatctgtcaggaccctgctctgcatatgagcagtggatagcttggattggagctgtagagagtggcacagcacagcgtcatcaaccatagcggtgagcagcacgcacggtcccatgcaatgcacctgccaggcgaacacggaggggaacatgcgctgcacctgcacggggttggattgcctcagctttttgcctttgcctttggttggaccagtgagaccgggacgggatgagagcgagacgacacggatggacgcatgaagcacaggcaccggcaagacatctggacatgtctatgtcagggtacgtacgcgtgcgctgcggtgggggagggggagcatcctctcgctctcggagggccagccgcacagcgcctcgctgttcgtccccgctcggaatcggagccccatgccaggccgccaccacaccacggccgggggggcacagcgacagctttgtgcagactgcacgcacgcacgatccactcagcttttggtctctctcgtctccttccttcgttttcctttcttatttcaagcttaactaaatttacgcaaaaaactactaactagcacaataataccaagcagtgccttaaattagtatcctattttaaaatataggctcaagttata

What is claimed is:

1. A method for producing a plurality of unique edits in a plant's T1 seed, the method comprising:
a) transforming at least one expression cassette into a plant cell or a plant tissue, wherein the at least one expression cassette comprises
   a nucleic acid that encodes a DNA modification enzyme,
   a nucleic acid that encodes at least one guide RNA (gRNA), and
   a floral mosaic (FMOS) regulatory sequence,
   wherein the FMOS regulatory sequence
      (i) mediates expression of the DNA modification enzyme in at least one of a floral primordia cell and a floral reproductive organ, and
      (ii) mediates a plurality of edits in the at least one of the floral primordia and the floral reproductive organ; and
b) regenerating the plant cell or plant tissue into a T0 plant having a plurality of T1 seed, wherein the T1 seed contain a plurality of unique edits;
wherein the FMOS regulatory sequence comprises an FMOS promotor selected from the group consisting of SEQ ID NO: 2, SEQ ID NO: 20, SEQ ID NO: 26, SEQ ID NO: 29, SEQ ID NO: 35, SEQ ID NO: 47, SEQ ID NO: 50, SEQ ID NO: 53, SEQ ID NO: 56, SEQ ID NO: 62, SEQ ID NO: 65, SEQ ID NO: 71, SEQ ID NO: 74, SEQ ID NO: 77, SEQ ID NO: 80, SEQ ID NO: 83, SEQ ID NO: 86, SEQ ID NO: 514, SEQ ID NO: 518, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 698, SEQ ID NO: 700, SEQ ID NO: 702, SEQ ID NO: 704, SEQ ID NO: 706, SEQ ID NO: 708, SEQ ID NO: 710, SEQ ID NO: 717, SEQ ID NO: 719, SEQ ID NO: 721, and SEQ ID NO: 723 or a sequence with at least 95% sequence identity thereto.

2. The method of claim 1, wherein the plurality of unique edits are selected from the group consisting of a plurality of unique allele replacements, a plurality of unique base insertions, and a plurality of unique base deletions.

3. The method of claim 1, wherein the DNA modification enzyme is a site-directed nuclease selected from the group consisting of a meganuclease (MN), a zinc-finger nuclease (ZFN), a transcription-activator like effector nuclease (TALEN), a Cas nuclease, a Cas9 nuclease, a Cpf1 nuclease, a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease.

4. The method of claim 1, wherein
the DNA modification enzyme is a Cas9 nuclease or a Cpf1 nuclease, and
the at least one expression cassette comprises the nucleic acid that encodes a gRNA, wherein the nucleic acid that encodes a gRNA is operably linked to the FMOS promoter or a second promoter.

5. The method of claim 4, wherein
the unique edit is an allele replacement, and
the at least one expression cassette further comprises a nucleic acid of interest (Donor DNA).

6. The method of claim 5, wherein the at least one expression cassette further comprises a replication promoter operably linked to the Donor DNA to drive replication of the Donor DNA.

7. The method of claim 5, wherein the at least one expression cassette further comprises at least one LIR.

8. The method of claim 1, further comprising
growing the T1 seed to produce a plurality of T1 plants, and
measuring at least one phenotype in plants of the T1 generation, and
selecting a plant of the T1 generation based on the measuring of at least one phenotype, wherein the selected plant has a unique edit.

9. The method of claim 8, further comprising
sequencing the insertion site of the Donor DNA in the selected plant of the T1 generation, sequencing the insertion site of the Donor DNA of a non-selected plant of the T1 generation, and aligning the insertion site sequence of the selected plant with the insertion site sequence of the non-selected plant.

10. The method of claim 8, further comprising crossing the selected plant of the T1 generation having a unique edit with a plant not having the unique edit to produce a progeny having the unique edit.

11. The method of claim 1, wherein the FMOS regulatory sequence mediates expression in at least one of an inflorescence, a microsporocyte, an anther, a stamen, a tapetum, megasporocyte, a pistil, an ovary, a style, and a stigma.

12. The method of claim 1, wherein the FMOS regulatory sequence mediates at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in vegetative tissue, and at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in a seed.

13. The method of claim 1, wherein the expression cassette further comprises an FMOS terminator selected from the group consisting of at least one of SEQ ID NO: 3, SEQ ID NO: 21, SEQ ID NO: 24, SEQ ID NO: 27, SEQ ID NO: 30, SEQ ID NO: 36, SEQ ID NO: 48, SEQ ID NO: 51, SEQ ID NO: 54, SEQ ID NO: 57, SEQ ID NO: 63, SEQ ID NO: 66, SEQ ID NO: 72, SEQ ID NO: 75, SEQ ID NO: 78, SEQ ID NO: 81, SEQ ID NO: 84, SEQ ID NO: 87, SEQ ID NO: 515, SEQ ID NO: 519, SEQ ID NO: 699, SEQ ID NO: 701, SEQ ID NO: 703, SEQ ID NO: 705, SEQ ID NO: 707, SEQ ID NO: 709, SEQ ID NO: 718, SEQ ID NO: 720, SEQ ID NO: 722, and SEQ ID NO: 724 or a sequence with at least 95% sequence identity thereto.

14. The method of claim 1, wherein the plurality of unique edits includes at least one of: at least 5, at least 10, at least 15, at least 20, at least 25, at least 30, at least 35, at least 40, at least 45, at least 50, at least 55, at least 60, at least 65, at least 70, at least 75, at least 80, at least 85, at least 90 at least 95 unique edits.

15. The method of claim 1, wherein the at least one expression cassette does not comprise translatable exons that are native to the FMOS regulatory sequence.

16. The method of claim 1, wherein FMOS regulatory sequence (i) mediates expression of the DNA modification enzyme in both a male and a female floral reproductive organ, and (ii) mediates a plurality of edits in both a male and a female floral reproductive organ.

17. The method of claim 16, wherein the expression of the DNA modification enzyme in the male floral reproductive organ is at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in vegetative tissue, and the expression of the DNA modification enzyme in the female floral reproductive organ is at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least 51×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more of the DNA modification enzyme in the floral primordia and the floral reproductive organ than in vegetative tissue.

18. At least one expression cassette for producing at least 10 unique edits in a plant's T1 seed, the expression cassette comprising:
a nucleic acid that encodes a DNA modification enzyme,
a nucleic acid that encodes at least one guide RNA (gRNA), and
a floral mosaic (FMOS) promoter,
wherein the FMOS promoter
(i) mediates expression of the DNA modification enzyme in at least one of a floral primordia cell and a floral reproductive organ, and
(ii) mediates a plurality of edits in the at least one of the floral primordia and the floral reproductive organ, and
(iii) mediates at least one of at least 2×, at least 3×, at least 4×, at least 5×, at least 6×, at least 7×, at least 8×, at least 9×, at least 10×, at least 11×, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least Six, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more expression of the DNA modification enzyme in the at least one of the floral primordia and the floral reproductive organ than in a vegetative tissue,
and at least one of at least 2×, at least 3×, at least 4×, at least 5×, at least 6×, at least 7×, at least 8×, at least 9×, at least 10×, at least Iix, at least 12×, at least 13×, at least 14×, at least 15×, at least 16×, at least 17×, at least 18×, at least 19×, at least 20×, at least 21×, at least 22×, at least 23×, at least 24×, at least 25×, at least 26×, at least 27×, at least 28× at least 27×, at least 28×, at least 29×, at least 30×, at least 31×, at least 32×, at least 33×, at least 34×, at least 35×, at least 36×, at least 37×, at least 38×, at least 39×, at least 40×, at least 41×, at least 42×, at least 43×, at least 44×, at least 45×, at least 46×, at least 47×, at least 48×, at least 49×, at least 50×, at least S1×, at least 52×, at least 53×, at least 54×, at least 55×, at least 56×, at least 57×, at least 58×, at least 59×, at least 60×, at least 61×, at least 62×, at least 63×, at least 64×, at least 65×, at least 66×, at least 67×, at least 68×, at least 69×, at least 70×, at least 71×, at least 72×, at least 73×, at least 74×, at least 75×, at least 76×, at least 77×, at least 78×, at least 79×, at least 80×, at least 81×, at least 82×, at least 83×, at least 84×, at least 85×, at least 86×, at least 87×, at least 88×, at least 89×, at least 90×, at least 91×, at least 92×, at least 93×, at least 94×, at least 95×, at least 96×, at least 97×, at least 98×, at least 99× and at least 100× more expression of the DNA modification enzyme in the at least one of the floral primordia and the floral reproductive organ than in a seed; and
wherein the FMOS promoter is selected from the group consisting of SEQ ID NO: 2, SEQ ID NO: 20, SEQ ID NO: 26, SEQ ID NO: 29, SEQ ID NO: 35, SEQ ID NO: 47, SEQ ID NO: 50, SEQ ID NO: 53, SEQ ID NO: 56, SEQ ID NO: 62, SEQ ID NO: 65, SEQ ID NO: 71, SEQ ID NO: 74, SEQ ID NO: 77, SEQ ID NO: 80, SEQ ID NO: 83, SEQ ID NO: 86, SEQ ID NO: 514, SEQ ID NO: 518, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 698, SEQ ID NO: 700, SEQ ID NO: 702, SEQ ID NO: 704, SEQ ID NO: 706, SEQ ID NO: 708, SEQ ID NO: 710, SEQ ID NO: 717, SEQ ID NO: 719, SEQ ID NO: 721, and SEQ ID NO: 723 or a sequence with at least 95% sequence identity thereto.

19. The cassette of claim 18, wherein
the DNA modification enzyme is a Cas9 nuclease or a Cpf1 nuclease;
the cassette comprises the nucleic acid that encodes a gRNA, wherein the nucleic acid that encodes a gRNA is operably linked to the FMOS promoter or a second promoter;
the cassette further comprises a nucleic acid of interest (Donor DNA) and a replication promoter operably linked to the Donor DNA to drive replication of the Donor DNA; and
the FMOS promoter mediates expression in at least one of an inflorescence, a microsporocyte, an anther, a stamen, a tapetum, megasporocyte, a pistil, an ovary, a style, and a stigma.

20. The cassette of claim 18, wherein the cassette further comprises a FMOS terminator selected from the group consisting of SEQ ID NO: 3, SEQ ID NO: 21, SEQ ID NO: 24, SEQ ID NO: 27, SEQ ID NO: 30, SEQ ID NO: 36, SEQ ID NO: 48, SEQ ID NO: 51, SEQ ID NO: 54, SEQ ID NO: 57, SEQ ID NO: 63, SEQ ID NO: 66, SEQ ID NO: 72, SEQ ID NO: 75, SEQ ID NO: 78, SEQ ID NO: 81, SEQ ID NO: 84, SEQ ID NO: 87, SEQ ID NO: 515, SEQ ID NO: 519, SEQ ID NO: 699, SEQ ID NO: 701, SEQ ID NO: 703, SEQ ID NO: 705, SEQ ID NO: 707, SEQ ID NO: 709, SEQ ID NO: 718, SEQ ID NO: 720, SEQ ID NO: 722, and SEQ ID NO: 724 or a sequence with at least 95% sequence identity thereto.

* * * * *